United States Patent 11,446,398 (REGULATED BIOCIRCUIT SYSTEMS) - sequence listing, part 7

SEQ ID NO: 25444 - protein, 432 aa, Homo sapiens
  Payload ID: 5037
  Gene Symbol: DDC
  Gene Name: dopa decarboxylase (aromatic L-amino acid decarboxylase)
  ENSP ID: ENSP00000478385
MNASEFRRRGKEMVDYMANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQGSASEATLVALLAARTKVIHRLQAASPELTQAAIMEKLVAYSSDQMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 25445 - protein, 442 aa, Homo sapiens
  Payload ID: 5037
  Gene Symbol: DDC
  Gene Name: dopa decarboxylase (aromatic L-amino acid decarboxylase)
  ENSP ID: ENSP00000479110
MNASEFRRRGKEMVDYMANYMEGIEGRQVYPDVEPGYLRPLIPAAAPQEPDTFEDIINDVEKIIMPGAASPACTELETVMMDWLGKMLELPKAFLNEKAGEGGGVIQGSASEATLVALLAARTKVIHRLQAASPELTQAAIMEKLVAYSSDQAHSSVERAGLIGGVKLKAIPSDGNFAMRASALQEALERDKAAGLIPFFMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRHWQIPLGRRFRSLKMWFVFRMYGVKGLQAYIRKHVQLSHEFESLVRQDPRFEICVEVILGLVCFRLKGSNKVNEALLQRINSAKKIHLVPCHLRDKFVLRFAICSRTVESAHVQRAWEHIKELAADVLRAERE

SEQ ID NO: 25446 - protein, 387 aa, Homo sapiens; identical to SEQ ID NO: 25441
  Payload ID: 5037
  Gene Symbol: DDC
  Gene Name: dopa decarboxylase (aromatic L-amino acid decarboxylase)
  Uniprot ID: P20711
  ENSP ID: ENSP00000484104

SEQ ID NO: 25447 - protein, 519 aa, Homo sapiens
  Payload ID: 5038
  Gene Symbol: DCT
  Gene Name: dopachrome tautomerase
  Uniprot ID: P40126
  ENSP ID: ENSP00000366227
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 25448 - protein, 552 aa, Homo sapiens
  Payload ID: 5038
  Gene Symbol: DCT
  Gene Name: dopachrome tautomerase
  Uniprot ID: P40126
  ENSP ID: ENSP00000392762
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVISNRLLYNATTNILEHVRKEKATKELPSLHVLVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 25449 - protein, 233 aa, Homo sapiens
  Payload ID: 5038
  Gene Symbol: DCT
  Gene Name: dopachrome tautomerase
  ENSP ID: ENSP00000431275
YSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVKRESDQGTPFPACAGNHEPGRLYSDFLLLA

SEQ ID NO: 25450 - protein, 244 aa, Homo sapiens
  Payload ID: 5039
  Gene Symbol: DBH
  Gene Name: dopamine beta-hydroxylase (dopamine beta-monooxygenase)
  ENSP ID: ENSP00000263611
MREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAK

SEQ ID NO: 25451 - protein, 617 aa, Homo sapiens
  Payload ID: 5039
  Gene Symbol: DBH
  Gene Name: dopamine beta-hydroxylase (dopamine beta-monooxygenase)
  Uniprot ID: P09172
  ENSP ID: ENSP00000376776
MPALSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 25452 - protein, 446 aa, Homo sapiens
  Payload ID: 5040
  Gene Symbol: DRD1
  Gene Name: dopamine receptor D1
  Uniprot ID: P21728
  ENSP ID: ENSP00000377353
MRTLNTSAMDGTGLVVERDFSVRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFRYERKMTPKAAFILISVAWTLSVLISFIPVQLSWHKAKPTSPSDGNATSLAETIDNCDSSLSRTYAISSSVISFYIPVAIMIVTYTRIYRIAQKQIRRIAALERAAVHAKNCQTTTGNGKPVECSQPESSFKMSFKRETKVLKTLSVIMGVFVCCWLPFFILNCILPFCGSGETQPFCIDSNTFDVFVWFGWANSSLNPIIYAFNADFRKAFSTLLGCYRLCPATNNAIETVSINNNGAAMFSSHHEPRGSISKECNLVYLIPHAVGSSEDLKKEEAAGIARPLEKLSPALSVILDYDTDVSLEKIQPITQNGQHPT

SEQ ID NO: 25453 - protein, 414 aa, Homo sapiens
  Payload ID: 5041
  Gene Symbol: DRD2
  Gene Name: dopamine receptor D2
  Uniprot ID: P14416
  ENSP ID: ENSP00000278597
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 25454 - protein, 443 aa, Homo sapiens
  Payload ID: 5041
  Gene Symbol: DRD2
  Gene Name: dopamine receptor D2
  Uniprot ID: P14416
  ENSP ID: ENSP00000354859
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 25455 - protein, 445 aa, Homo sapiens
  Payload ID: 5041
  Gene Symbol: DRD2
  Gene Name: dopamine receptor D2
  Uniprot ID: P14416
  ENSP ID: ENSP00000438215
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVVQEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 25456 - protein, 177 aa, Homo sapiens
  Payload ID: 5041
  Gene Symbol: DRD2
  Gene Name: dopamine receptor D2
  ENSP ID: ENSP00000438419
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNA

SEQ ID NO: 25457 - protein, 442 aa, Homo sapiens
  Payload ID: 5041
  Gene Symbol: DRD2
  Gene Name: dopamine receptor D2
  ENSP ID: ENSP00000441068
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 25458 - protein, 7 aa, Homo sapiens
  Payload ID: 5041
  Gene Symbol: DRD2
  Gene Name: dopamine receptor D2
  ENSP ID: ENSP00000441474
MDPLNLS

SEQ ID NO: 25459 - protein, 443 aa, Homo sapiens; identical to SEQ ID NO: 25454
  Payload ID: 5041
  Gene Symbol: DRD2
  Gene Name: dopamine receptor D2
  Uniprot ID: P14416
  ENSP ID: ENSP00000442172

SEQ ID NO: 25460 - protein, 367 aa, Homo sapiens
  Payload ID: 5042
  Gene Symbol: DRD3
  Gene Name: dopamine receptor D3
  ENSP ID: ENSP00000295881
MASLSQLSGHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLMPLREKKATQMVAIVLGAFIVCWLPFFLTHVLNTHCQTCHVSPELYSATTWLGYVNSALNPVIYTTFNIEFRKAFLKILSC

SEQ ID NO: 25461 - protein, 400 aa, Homo sapiens
  Payload ID: 5042
  Gene Symbol: DRD3
  Gene Name: dopamine receptor D3
  Uniprot ID: P35462
  ENSP ID: ENSP00000373169
MASLSQLSGHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSPTIAPKLSLEVRKLSNGRLSTSLKLGPLQPRGVPLREKKATQMVAIVLGAFIVCWLPFFLTHVLNTHCQTCHVSPELYSATTWLGYVNSALNPVIYTTFNIEFRKAFLKILSC

SEQ ID NO: 25462 - protein, 400 aa, Homo sapiens; identical to SEQ ID NO: 25461
  Payload ID: 5042
  Gene Symbol: DRD3
  Gene Name: dopamine receptor D3
  Uniprot ID: P35462
  ENSP ID: ENSP00000419402

SEQ ID NO: 25463 - protein, 400 aa, Homo sapiens; identical to SEQ ID NO: 25461
  Payload ID: 5042
  Gene Symbol: DRD3
  Gene Name: dopamine receptor D3
  Uniprot ID: P35462
  ENSP ID: ENSP00000420662

SEQ ID NO: 25464 - protein, 419 aa, Homo sapiens
  Payload ID: 5043
  Gene Symbol: DRD4
  Gene Name: dopamine receptor D4
  Uniprot ID: P21917
  ENSP ID: ENSP00000176183
MGNRSTADADGLLAGRGPAAGASAGASAGLAGQGAAALVGGVLLIGAVLAGNSLVCVSVATERALQTPTNSFIVSLAAADLLLALLVLPLFVYSEVQGGAWLLSPRLCDALMAMDVMLCTASIFNLCAISVDRFVAVAVPLRYNRQGGSRRQLLLIGATWLLSAAVAAPVLCGLNDVRGRDPAVCRLEDRDYVVYSSVCSFFLPCPLMLLLYWATFRGLQRWEVARRAKLHGRAPRRPSGPGPPSPTPPAPRLPQDPCGPDCAPPAPGLPRGPCGPDCAPAAPSLPQDPCGPDCAPPAPGLPPDPCGSNCAPPDAVRAAALPPQTPPQTRRRRRAKITGRERKAMRVLPVVVGAFLLCWTPFFVVHITQALCPACSVPPRLVSAVTWLGYVNSALNPVIYTVFNAEFRNVFRKALRACC

SEQ ID NO: 25465 - protein, 419 aa, Homo sapiens; identical to SEQ ID NO: 25464
  Payload ID: 5043
  Gene Symbol: DRD4
  Gene Name: dopamine receptor D4
  ENSP ID: ENSP00000478431

SEQ ID NO: 25466 - protein, 477 aa, Homo sapiens
  Payload ID: 5044
  Gene Symbol: DRD5
  Gene Name: dopamine receptor D5
  Uniprot ID: P21918
  ENSP ID: ENSP00000306129
MLPPGSNGTAYPGQFALYQQLAQGNAVGGSAGAPPLGPSQVVTACLLTLLIIWTLLGNVLVCAAIVRSRHLRANMTNVFIVSLAVSDLFVALLVMPWKAVAEVAGYWPFGAFCDVWVAFDIMCSTASILNLCVISVDRYWAISRPFRYKRKMTQRMALVMVGLAWTLSILISFIPVQLNWHRDQAASWGGLDLPNNLANWTPWEEDFWEPDVNAENCDSSLNRTYAISSSLISFYIPVAIMIVTYTRIYRIAQVQIRRISSLERAAEHAQSCRSSAACAPDTSLRASIKKETKVLKTLSVIMGVFVCCWLPFFILNCMVPFCSGHPEGPPAGFPCVSETTFDVFVWFGWANSSLNPVIYAFNADFQKVFAQLLGCSHFCSRTPVETVNISNELISYNQDIVFHKEIAAAYIHMMPNAVTPGNREVDNDEEEGPFDRMFQIYQTSPDGDPVAESVWELDCEGEISLDKITPFTPNGFH

SEQ ID NO: 25467 - protein, 2465 aa, Homo sapiens
  Payload ID: 5045
  Gene Symbol: DOPEY1
  Gene Name: dopey family member 1
  Uniprot ID: Q5JWR5
  ENSP ID: ENSP00000195654
MNTEELELLSDSKYRNYVAAIDKALKNFEYSSEWADLISALGKLNKVLQNNAKYQVVPKKLTIGKRLAQCLHPALPGGVHRKALETYEIIFKIIGPKRLAKDLFLYSSGLFPLLANAAMSVKPTLLSLYEIYYLPLGKTLKPGLQGLLTGILPGLEEGSEYYERTNMLLEKVAAAVDQSAFYSALWGSLLTSPAVRLPGITYVLAHLNRKLSMEDQLYIIGSDIELMVEAVSTSVQDSSVLVQRSTLDLILFCFPFHMSQATRPDMIRILSAALHVVLRRDMSLNRRLYAWLLGFDNNGAIIGPRSTRHSNPEEHATYYFTTFSKELLVQAMVGILQVNGFGEENTLMQDLKPFRILISLLDKPELGPVILEDVLIEVFRTLYSQCKAELDLQTEPPFSKDHAQLSSKLRENKKTAELIKTANLLFNSFEPYYMWDYVARWFEECCRRTLHVRLQIGPGDSNDSSELQLTNFCLLVDFLLDIVSLPTRSMRVLCQETYIEIQTEHLPQLLLRMISALTSHLQTLHLSELTDSLRLCSKILSKVQPPLLSASTGGVLQFPSGQNNSVKEWEDKKVSSVSHENPTEVFEDGENPPSSRSSESGFTEFIQYQADRTDDIDRELSEGQGAAAIPIGSTSSETETASTVGSEETIIQTPSVVTQGTATRSRKTAQKTAMQCCLEYVQQFLTRLINLYIIQNNSFSQSLATEHQGDLGREQGETSKWDRNSQGDVKEKNISKQKTSKEYLSAFLAACQLFLECSSFPVYIAEGNHTSELRSEKLETDCEHVQPPQWLQTLMNACSQASDFSVQSVAISLVMDLVGLTQSVAMVTGENINSVEPAQPLSPNQGRVAVVIRPPLTQGNLRYIAEKTEFFKHVALTLWDQLGDGTPQHHQKSVELFYQLHNLVPSSSICEDVISQQLTHKDKKIRMEAHAKFAVLWHLTRDLHINKSSSFVRSFDRSLFIMLDSLNSLDGSTSSVGQAWLNQVLQRHDIARVLEPLLLLLLHPKTQRVSVQRVQAERYWNKSPCYPGEESDKHFMQNFACSNVSQVQLITSKGNGEKPLTMDEIENFSLTVNPLSDRLSLLSTSSETIPMVVSDFDLPDQQIEILQSSDSGCSQSSAGDNLSYEVDPETVNAQEDSQMPKESSPDDDVQQVVFDLICKVVSGLEVESASVTSQLEIEAMPPKCSDIDPDEETIKIEDDSIQQSQNALLSNESSQFLSVSAEGGHECVANGISRNSSSPCISGTTHTLHDSSVASIETKSRQRSHSSIQFSFKEKLSEKVSEKETIVKESGKQPGAKPKVKLARKKDDDKKKSSNEKLKQTSVFFSDGLDLENWYSCGEGDISEIESDMGSPGSRKSPNFNIHPLYQHVLLYLQLYDSSRTLYAFSAIKAILKTNPIAFVNAISTTSVNNAYTPQLSLLQNLLARHRISVMGKDFYSHIPVDSNHNFRSSMYIEILISLCLYYMRSHYPTHVKVTAQDLIGNRNMQMMSIEILTLLFTELAKVIESSAKGFPSFISDMLSKCKVQKVILHCLLSSIFSAQKWHSEKMAGKNLVAVEEGFSEDSLINFSEDEFDNGSTLQSQLLKVLQRLIVLEHRVMTIPEENETGFDFVVSDLEHISPHQPMTSLQYLHAQPITCQGMFLCAVIRALHQHCACKMHPQWIGLITSTLPYMGKVLQRVVVSVTLQLCRNLDNLIQQYKYETGLSDSRPLWMASIIPPDMILTLLEGITAIIHYCLLDPTTQYHQLLVSVDQKHLFEARSGILSILHMIMSSVTLLWSILHQADSSEKMTIAASASLTTINLGATKNLRQQILELLGPISMNHGVHFMAAIAFVWNERRQNKTTTRTKVIPAASEEQLLLVELVRSISVMRAETVIQTVKEVLKQPPAIAKDKKHLSLEVCMLQFFYAYIQRIPVPNLVDSWASLLILLKDSIQLSLPAPGQFLILGVLNEFIMKNPSLENKKDQRDLQDVTHKIVDAIGAIAGSSLEQTTWLRRNLEVKPSPKIMVDGTNLESDVEDMLSPAMETANITPSVYSVHALTLLSEVLAHLLDMVFYSDEKERVIPLLVNIMHYVVPYLRNHSAHNAPSYRACVQLLSSLSGYQYTRRAWKKEAFDLFMDPSFFQMDASCVNHWRAIMDNLMTHDKTTFRDLMTRVAVAQSSSLNLFANRDVELEQRAMLLKRLAFAIFSSEIDQYQKYLPDIQERLVESLRLPQVPTLHSQVFLFFRVLLLRMSPQHLTSLWPTMITELVQVFLLMEQELTADEDISRTSGPSVAGLETTYTGGNGFSTSYNSQRWLNLYLSACKFLDLALALPSENLPQFQMYRWAFIPEASDDSGLEVRRQGIHQREFKPYVVRLAKLLRKRAKKNPEEDNSGRTLGWEPGHLLLTICTVRSMEQLLPFFNVLSQVFNSKVTSRCGGHSGSPILYSNAFPNKDMKLENHKPCSSKARQKIEEMVEKDFLEGMIKT

SEQ ID NO: 25468 - protein, 2476 aa, Homo sapiens
  Payload ID: 5045
  Gene Symbol: DOPEY1
  Gene Name: dopey family member 1
  ENSP ID: ENSP00000237163
MNTEELELLSDSKYRNYVAAIDKALKNFEYSSEWADLISALGKLNKVLQNNAKYQVVPKKLTIGKRLAQCLHPALPGGVHRKALETYEIIFKIIGPKRLAKDLFLYSSGLFPLLANAAMSVKPTLLSLYEIYYLPLGKTLKPGLQGLLTGILPGLEEGSEYYERTNMLLEKVAAAVDQSAFYSALWGSLLTSPAVRLPGITYVLAHLNRKLSMEDQLYIIGSDIELMVEAVSTSVQDSSVLVQRSTLDLILFCFPFHMSQATRPDMIRILSAALHVVLRRDMSLNRRLYAWLLGPRSTRHSNPEEHATYYFTTFSKELLVQAMVGILQVNGFGEENTLMQDLKPFRILISLLDKPELGPVILEDVLIEVFRTLYSQCKAELDLQTEPPFSKDHAQLSSKLRENKKTAELIKTANLLFNSFEPYYMWDYVARWFEECCRRTLHVRLQIGPGDSNDSSELQLTNFCLLVDFLLDIVSLPTRSMRVLCQETYIEIQTEHLPQLLLRMISALTSHLQTLHLSELTDSLRLCSKILSKVQPPLLSASTGGVLQFPSGQNNSVKEWEDKKVSSVSHENPTEVFEDGENPPSSRSSESGFTEFIQYQADRTDDIDRELSEGQGAAAIPIGSTSSETETASTVGSEETIIQTPSVVTQGTATRSRKTAQKTAMQCCLEYVQQFLTRLINLYIIQNNSFSQSLATEHQGDLGREQGETSKWDRNSQGDVKEKNISKQKTSKEYLSAFLAACQLFLECSSFPVYIAEGNHTSELRSEKLETDCEHVQPPQWLQTLMNACSQASDFSVQSVAISLVMDLVGLTQSVAMVTGENINSVEPAQPLSPNQGRVAVVIRPPLTQGNLRYIAEKTEFFKHVALTLWDQLGDGTPQHHQKSVELFYQLHNLVPSSSICEDVISQQLTHKDKKIRMEAHAKFAVLWHLTRDLHINKSSSFVRSFDRSLFIMLDSLNSLDGSTSSVGQAWLNQVLQRHDIARVLEPLLLLLLHPKTQRVSVQRVQAERYWNKSPCYPGEESDKHFMQNFACSNVSQVQLITSKGNGEKPLTMDEIENFSLTVNPLSDRLSLLSTSSETIPMVVSDFDLPDQQIEILQSSDSGCSQSSAGDNLSYEVDPETVNAQEDSQMPKESSPDDDVQQVVFDLICKVVSGLEVESASVTSQLEIEAMPPKCSDIDPDEETIKIEDDSIQQSQNALLSNESSQFLSVSAEGGHECVANGISRNSSSPCISGTTHTLHDSSVASIETKSRQRSHSSIQFSFKEKLSEKVSEKETIVKESGKQPGAKPKVKLARKKDDDKKKSSNEKLKQTSVFFSDGLDLENWYSCGEGDISEIESDMGSPGSRKSPNFNIHPLYQHVLLYLQLYDSSRTLYAFSAIKAILKTNPIAFVNAISTTSVNNAYTPQLSLLQNLLARHRISVMGKDFYSHIPVDSNHNFRSSMYIEILISLCLYYMRSHYPTHVKVTAQDLIGNRNMQMMSIEILTLLFTELAKVIESSAKGFPSFISDMLSKCKVQKVILHCLLSSIFSAQKWHSEKMAGKNLVAVEEGFSEDSLINFSEDEFDNGSTLQSQLLKVLQRLIVLEHRVMTIPEENETGFDFVVSDLEHISPHQPMTSLQYLHAQPITCQGMFLCAVIRALHQHCACKMHPQWIGLITSTLPYMGKVLQRVVVSVTLQLCRNLDNLIQQYKYETGLSDSRPLWMASIIPPDMILTLLEGITAIIHYCLLDPTTQYHQLLVSVDQKHLFEARSGILSILHMIMSSVTLLWSILHQADSSEKMTIAASASLTTINLGATKNLRQQILELLGPISMNHGVHFMAAIAFVWNERRQNKTTTRTKVIPAASEEQLLLVELVRSISVMRAETVIQTVKEVLKQPPAIAKDKKHLSLEVCMLQFFYAYIQRIPVPNLVDSWASLLILLKDSIQLSLPAPGQFLILGVLNEFIMKNPSLENKKDQRDLQDVTHKIVDAIGAIAGSSLEQTTWLRRNLEVKPSPKIMVDGTNLESDVEDMLSPAMETANITPSVYSVHALTLLSEVLAHLLDMVFYSDEKERVIPLLVNIMHYVVPYLRNHSAHNAPSYRACVQLLSSLSGYQYTRRAWKKEAFDLFMDPSFFQMDASCVNHWRAIMDNLMTHDKTTFRDLMTRVAVAQSSSLNLFANRDVELEQRAMLLKRLAFAIFSSEIDQYQKYLPDIQERLVESLRLPQVPTLHSQVFLFFRVLLLRMSPQHLTSLWPTMITELVQVFLLMEQELTADEDISRTSGPSVAGLETTYTGGNGFSTSYNSQRWLNLYLSACKFLDLALALPSENLPQFQMYRWAFIPEASDDSGLEVRRQGIHQREFKPYVVRLAKLLRKRAKDKEEDFKTVILEGLEMAKHQKNPEEDNSGRTLGWEPGHLLLTICTVRSMEQLLPFFNVLSQVFNSKVTSRCGGHSGSPILYSNAFPNKDMKLENHKPCSSKARQKIEEMVEKDFLEGMIKT

SEQ ID NO: 25469 - protein, 2476 aa, Homo sapiens; identical to SEQ ID NO: 25468
  Payload ID: 5045
  Gene Symbol: DOPEY1
  Gene Name: dopey family member 1
  ENSP ID: ENSP00000358754

SEQ ID NO: 25470 - protein, 171 aa, Homo sapiens
  Payload ID: 5045
  Gene Symbol: DOPEY1
  Gene Name: dopey family member 1
  ENSP ID: ENSP00000474846
  MOD_RES (1)..(1): Any amino acid
XKLRENKKTAELIKTANLLFNSFEPYYMWDYVARWFEECCRRTLHVRLQIGPGDSNDSSELQLTNFCLLVDFLLDIVSLETYIEIQTEHLPQLLLRMISALTSHLQTLHLSELTDSLRLCSKILSKVQPPLLSASTGGVLQFPSGQNNSVKEWEDKKVSSVSHENPTEVFE

SEQ ID NO: 25471 - protein, 145 aa, Homo sapiens
  Payload ID: 5046
  Gene Symbol: DOPEY2
  Gene Name: dopey family member 2
  ENSP ID: ENSP00000270190
MDPEEQELLNDYRYRSYSSVIEKALRNFESSSEWADLISSLGKLNKALQSNLRYSLLPRRLLISKRLAQCLHPALPSGVHLKALETYEIIFKIVGTKWLAKDLFLYSCGLFPLLAHAAVSVRPVLLTLYEKYFLPLQKLLLPSLQ

SEQ ID NO: 25472 - protein, 2298 aa, Homo sapiens
  Payload ID: 5046
  Gene Symbol: DOPEY2
  Gene Name: dopey family member 2
  Uniprot ID: Q9Y3R5
  ENSP ID: ENSP00000382104
MDPEEQELLNDYRYRSYSSVIEKALRNFESSSEWADLISSLGKLNKALQSNLRYSLLPRRLLISKRLAQCLHPALPSGVHLKALETYEIIFKIVGTKWLAKDLFLYSCGLFPLLAHAAVSVRPVLLTLYEKYFLPLQKLLLPSLQAFIVGLLPGLEEGSEISDRTDALLLRLSLVVGKEVFYTALWGSVLASPSIRLPASVFVVGHINRDAPGREQKYMLGTNHQLTVKSLRASLLDSNVLVQRNNLEIVLFFFPFYTCLDSNERAIPLLRSDIVRILSAATQTLLRRDMSLNRRLYAWLLGSDIKGNTVVPESEISNSYEDQSSYFFEKYSKDLLVEGLAEILHQKFIDADVEERHHAYLKPFRVLISLLDKPEIGPQVVGNLFLEVIRAFYSYCRDALGSDLKLSYTQSGNSLISAIKENRNASEIVKTVNLLITSLSTDFLWDYMTRCFEECFRPVKQRYSVRNSVSPPPTVSELCALLVFLLDVIPLELYSEVQTQYLPQVLGCLVQPLAEDMEALSLPELTHALKTCFKVLSKVQMPPSYLDTESTSGTSSPVKGENGKIILETKAVIPGDEDASFPPLKSEDSGIGLSASSPELSEHLRVPRVSLERDDVWKKGGSMQRTFLCIQELIANFASKNIFGVQLTASGEESKSEEPAGKRDRDGTQSLAANDSSRKNSWEPKPITVPQFKQMLSDLFTARGSPFKTKSSESPSSSPSSPARKNGGEWDVEKVVIDLGGSREERREAFAAACHLLLDCATFPVYLSEEETEQLCATLFQLPGAGDSSFPSWLKSLMTICCCVTDCYLQNVAISTLLEVINHSQSLALVIEDKMKRYKSSGHNPFFGKLQMVTVPPIAPGILKVIAEKTDFYQRVARVLWNQLNKETREHHVTCVELFYRLHCLAPTANICEDIICHALLDPDKGTRLEALFRFSVIWHLTREIQGSRVTSHNRSFDRSLFVVLDSLACTDGAIGAAAQGWLVRALSLGDVARILEPVLLLLLQPKTQRTSIHCLKQENSADDLHRWFNRKKTSFREACAVPEPQESGSEEHLPLSQFTTVDREAIWAEVEKEPEKYPLRGELSEEELPYYVELPDRTAHGAPDSSEHTESADTSSCHTDSENTSSFSSPSHDLQELSNEENCCAPIPMGGRAYPKRSALLAAFQSESFKAGAKLSLVRVDSDKTQASESFSSDEEADLELQALTTSRLLKQQRERQEAVEALFKHILLYLQPYDSRRVLYAFSVLEAVLKTNPKEFIEAVSRTSMDTSSTAHLNLISNLLARHQEALIGQSFYGKLQTQVPNVCPHSLLLELLTYLCLSFLRSYYPCYLKVSHRDILGNRDVQVKSVEVLIRIMMQLVSVAKSSEGKNVEFIHSLLQRCKVQEFVLLSLSASMYTSQKRYGLATAHHGRALPEDSLFEESLINLGQDQIWSEHPLQIELLKLLQVLIVLEHHLGRAHEEAENQPDLSREWQRALNFQQAISALQYVQPHPLTSQGLLVSAVVRGLQPAYGYGMHPAWVSLVTHSLPYFGKSLGWTVTPFVVQICKNLDDLVKQYESESVKLSVSTTSKRENISPDYPLTLLEGLTTISHFCLLEQANQNKKTMAAGDPANLRNARNAILEELPRTVNTMALLWNVLRKEETQKRPVDLLGATKGSSSVYFKTTKTIRQKILDFLNPLTAHLGVQLTAAVAAVWSRKKAQRHSKMKIIPTASASQLTLVDLVCALSTLQTDTLLHLVKEVVKRPPQVKGGDEKSPLVDIPVLQFCYAFLQRLPVPALQENFSSLLGVLKESVQLNLAPPGYFLLLSMLNDFVTRTPNLENKKDQKDLQEITQKILEAVGNIAGSSLEQTSWLSRNLEVKAQPQASLEESDAEEDLYDAAAASAMVSSSAPSVYSVQALSLLAEVLASLLDMVYRSDEKEKAVPLISRLLYYVFPYLRNHSAYNAPSFRAGAQLLSSLSGYAYTKRAWRKEVLELFLDPAFFQMDTSCVHWKSIIDHLLTHEKTMFKDLMNMQSSSLKLFSSFEQKAMLLKRQAFAVFSGELDQYHLYLPLIQERLTDNLRVGQTSIVAAQMFLFFRVLLLRISPQHLTSLWPIMVSELIQTFTQLEEDLKDEDESLRSTNKVNRTKVSVPDANGPSVGEIPQSELILYLSACKFLDTALSFPPDKMPLFQIYRWAFIPEVDTEGPAFLSDVEENHQECKPHTVRILELLKLKFGEISSSDEITMKSEFPLLRQHSVSSIRQLMPFFMTLNGAFKTQRQLPADSPGTPFLDFPVTDSPRILKQLEECIEYDFLEHPEC

SEQ ID NO: 25473 - protein, 349 aa, Homo sapiens
  Payload ID: 5047
  Gene Symbol: DRAXIN
  Gene Name: dorsal inhibitory axon guidance protein
  Uniprot ID: Q8NBI3
  ENSP ID: ENSP00000294485
MAGPAIHTAPMLFLVLLLPLELSLAGALAPGTPARNLPENHIDLPGPALWTPQASHHRRRGPGKKEWGPGLPSQAQDGAVVTATRQASRLPEAEGLLPEQSPAGLLQDKDLLLGLALPYPEKENRPPGWERTRKRSREHKRRRDRLRLHQGRALVRGPSSLMKKAELSEAQVLDAAMEESSTSLAPTMFFLTTFEAAPATEESLILPVTSLRPQQAQPRSDGEVMPTLDMALFDWTDYEDLKPDGWPSAKKKEKHRGKLSSDGNETSPAEGEPCDHHQDCLPGTCCDLREHLCTPHNRGLNNKCFDDCMCVEGLRCYAKFHRNRRVTRRKGRCVEPETANGDQGSFINV

SEQ ID NO: 25474 - protein, 263 aa, Homo sapiens
  Payload ID: 5048
  Gene Symbol: DRGX
  Gene Name: dorsal root ganglia homeobox
  Uniprot ID: A6NNA5
  ENSP ID: ENSP00000363254
MFYFHCPPQLEGTATFGNHSSGDFDDGFLRRKQRRNRTTFTLQQLEALEAVFAQTHYPDVFTREELAMKINLTEARVQVWFQNRRAKWRKTERGASDQEPGAKEPMAEVTPPPVRNINSPPPGDQARSKKEALEAQQSLGRTVGPAGPFFPSCLPGTLLNTATYAQALSHVASLKGGPLCSCCVPDPMGLSFLPTYGCQSNRTASVATLRMKAREHSEAVLQSANLLPSTSSSPGPVAKPAPPDGSQEKTSPTKEQSEAEKSV

SEQ ID NO: 25475 - protein, 263 aa, Homo sapiens; identical to SEQ ID NO: 25474
  Payload ID: 5048
  Gene Symbol: DRGX
  Gene Name: dorsal root ganglia homeobox
  Uniprot ID: A6NNA5
  ENSP ID: ENSP00000401653

SEQ ID NO: 25476 - protein, 1537 aa, Homo sapiens
  Payload ID: 5049
  Gene Symbol: DOT1L
  Gene Name: DOT1-like histone H3K79 methyltransferase
  Uniprot ID: Q8TEK3
  ENSP ID: ENSP00000381657
MGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAATPTKGPEGKVAGPADAPMDSGAEEEKAGAATVKKPSPSKARKKKLNKKGRKMAGRKRGRPKKMNTANPERKPKKNQTALDALHAQTVSQTAASSPQDAYRSPHSPFYQLPPSVQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGN

SEQ ID NO: 25477 - protein, 208 aa, Homo sapiens
  Payload ID: 5049
  Gene Symbol: DOT1L
  Gene Name: DOT1-like histone H3K79 methyltransferase
  ENSP ID: ENSP00000404284
MGEKLELRLKSPVGAEPAVYPWPLPVYDKHHDAAHEIIETIRWVCEEIPDLKLAMENYVLIDYDTKSFESMQRLCDKYNRAIDSIHQLQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERI

SEQ ID NO: 25478 - protein, 653 aa, Homo sapiens
  Payload ID: 5049
  Gene Symbol: DOT1L
  Gene Name: DOT1-like histone H3K79 methyltransferase
  ENSP ID: ENSP00000407411
SGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGEGHRAQGHQSITFSRGGHLLGVAARALARLWELVLGVFNHAVPSASAHPFGARVGRGAACGSATLGPSPLQAAASASASSFQAPASVETRPPPPPPPPPPPLPPPAHLGRSPAGPPVLHAPPPPNAALPPPPTLLASNPEPALLQSLASLPPNQAFLPPTSAASLPPANASLSIKLTSLPHKGARPSFTVHHQPLPRLALAQAAPGIPQASATGPSAVWVSLGMPPPYAAHLSGVKPR

SEQ ID NO: 25479 - protein, 125 aa, Homo sapiens
  Payload ID: 5049
  Gene Symbol: DOT1L
  Gene Name: DOT1-like histone H3K79 methyltransferase
  ENSP ID: ENSP00000412916
GPFPPGPQFALGPMSLQANLGSVAGSSVLQSLFSSVPAAAGLVHVSSAATRLTNSHAMGSFSGVAGGTVGGVFNHAVPSASAHPFGARVGRGAACGSATLGPSPLQAAASASASSFQAPASVETR

SEQ ID NO: 25480 - protein, 142 aa, Homo sapiens
  Payload ID: 5049
  Gene Symbol: DOT1L
  Gene Name: DOT1-like histone H3K79 methyltransferase
  ENSP ID: ENSP00000476469
QAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQSPIPSTLCPPAHLTCPQRGFTVDGPGALSLDLCCLFK

SEQ ID NO: 25481 - protein, 69 aa, Homo sapiens
  Payload ID: 5049
  Gene Symbol: DOT1L
  Gene Name: DOT1-like histone H3K79 methyltransferase
  ENSP ID: ENSP00000484015
  MOD_RES (1)..(1): Any amino acid
XELRLKSPVGAEPAVYPWPLPVYDKHHDAAHEIIETIRWVCEEIPDLKLAMENYVLIDYDTKSCWLRKT

SEQ ID NO: 25482 - protein, 400 aa, Homo sapiens
  Payload ID: 5050
  Gene Symbol: DOC2A
  Gene Name: double C2-like domains, alpha
  Uniprot ID: Q14183
  ENSP ID: ENSP00000340017
MRGRRGDRMTINIQEHMAINVCPGPIRPIRQISDYFPRGPGPEGGGGGGGEAPAHLVPLALAPPAALLGATTPEDGAEVDSYDSDDATALGTLEFDLLYDRASCTLHCSILRAKGLKPMDFNGLADPYVKLHLLPGACKANKLKTKTQRNTLNPVWNEDLTYSGITDDDITHKVLRIAVCDEDKLSHNEFIGEIRVPLRRLKPSQKKHFNICLERQVPLASPSSMSAALRGISCYLKELEQAEQGQGLLEERGRILLSLSYSSRRRGLLVGILRCAHLAAMDVNGYSDPYVKTYLRPDVDKKSKHKTCVKKKTLNPEFNEEFFYEIELSTLATKTLEVTVWDYDIGKSNDFIGGVSLGPGARGEARKHWSDCLQQPDAALERWHTLTSELPPAAGALSSA

SEQ ID NO: 25483 - protein, 80 aa, Homo sapiens
  Payload ID: 5050
  Gene Symbol: DOC2A
  Gene Name: double C2-like domains, alpha
  ENSP ID: ENSP00000454827
MDFNGLADPYVKLHLLPGACKANKLKTKTQRNTLNPVWNEDLTYSGITDDDITHKVLRIAVCDEDKLSHNEFIGEIRVPL

SEQ ID NO: 25484 - protein, 163 aa, Homo sapiens
  Payload ID: 5050
  Gene Symbol: DOC2A
  Gene Name: double C2-like domains, alpha
  Uniprot ID: Q14183
  ENSP ID: ENSP00000454857
MDFNGLADPYVKLHLLPGACKANKLKTKTQRNTLNPVWNEDLTYSGITDDDITHKVLRIAVCDEDKLSHNEFIGEIRVPLRRLKPSQKKHFNICLERQVPLASPSSMSAALRGISCYLKELEQAEQGQGLLEERGRILLSLSYSSRRRGLLVPEARCGQEIQA

SEQ ID NO: 25485 - protein, 400 aa, Homo sapiens; identical to SEQ ID NO: 25482
  Payload ID: 5050
  Gene Symbol: DOC2A
  Gene Name: double C2-like domains, alpha
  Uniprot ID: Q14183
  ENSP ID: ENSP00000455196

SEQ ID NO: 25486 - protein, 400 aa, Homo sapiens; identical to SEQ ID NO: 25482
  Payload ID: 5050
  Gene Symbol: DOC2A
  Gene Name: double C2-like domains, alpha
  Uniprot ID: Q14183
  ENSP ID: ENSP00000455624

SEQ ID NO: 25487 - protein, 203 aa, Homo sapiens
  Payload ID: 5050
  Gene Symbol: DOC2A
  Gene Name: double C2-like domains, alpha
  ENSP ID: ENSP00000456704
MRGRRGDRMTINIQEHMAINVCPGPIRPIRQISDYFPRGPGPEGGGGGGGEAPAHLVPLALAPPAALLGATTPEDGAEVDSYDSDDATALGTLEFDLLYDRASCTLHCSILRAKGLKPMDFNGLADPYVKLHLLPGACKANKLKTKTQRNTLNPVWNEDLTYSGITDDDITHKVLRIAVCDEDKLSHNEFIGEIRVPLRRLKP

SEQ ID NO: 25488 - protein, 218 aa, Homo sapiens
  Payload ID: 5050
  Gene Symbol: DOC2A
  Gene Name: double C2-like domains, alpha
  ENSP ID: ENSP00000457184
MRGRRGDRMTINIQEHMAINVCPGPIRPIRQISDYFPRGPGPEGGGGGGGEAPAHLVPLALAPPAALLGATTPEDGAEVDSYDSDDATALGTLEFDLLYDRASCTLHCSILRAKGLKPMDFNGLADPYVKLHLLPGACKANKLKTKTQRNTLNPVWNEDLTYSGITDDDITHKVLRIAVCDEDKLSHNEFIGEIRVPLRRLKPSQKKHFNICLERQVP

SEQ ID NO: 25489 - protein, 53 aa, Homo sapiens
  Payload ID: 5050
  Gene Symbol: DOC2A
  Gene Name: double C2-like domains, alpha
  ENSP ID: ENSP00000457454
MDFNGLADPYVKLHLLPGACKANKLKTKTQRNTLNPVWNEDLTYSGITDDDIT

SEQ ID NO: 25490 - protein, 59 aa, Homo sapiens
  Payload ID: 5050
  Gene Symbol: DOC2A
  Gene Name: double C2-like domains, alpha
  ENSP ID: ENSP00000458670
MDFNGLADPYVKLHLLPGACKANKLKTKTQRNTLNPVWNEDLTYSGITDDDITHKDRRL

SEQ ID NO: 25491 - protein, 13 aa, Homo sapiens
  Payload ID: 5050
  Gene Symbol: DOC2A
  Gene Name: double C2-like domains, alpha
  ENSP ID: ENSP00000460622
MDFNGLADPYVKL

SEQ ID NO: 25492 - protein, 400 aa, Homo sapiens; identical to SEQ ID NO: 25482
  Payload ID: 5050
  Gene Symbol: DOC2A
  Gene Name: double C2-like domains, alpha
  Uniprot ID: Q14183
  ENSP ID: ENSP00000482870

SEQ ID NO: 25493 - protein, 412 aa, Homo sapiens
  Payload ID: 5051
  Gene Symbol: DOC2B
  Gene Name: double C2-like domains, beta
  ENSP ID: ENSP00000417238
MTLRRRGEKATISIQEHMAIDVCPGPTRPIKQISDYFPRFPRGLPPDAGPRAAAPPDAPARPAVAGAGRRSPSDGAREDDEDVDQLFGAYGSSPGPSPGPSPARPPAKPPEDEPDADGYESDDCTALGTLDFSLLYDQENNALHCTITKAKGLKPMDHNGLADPYVKLHLLPGASKANKLRTKTLRNTLNPTWNETLTYYGITDEDMIRKTLRISVCDEDKFRHNEFIGETRVPLKKLKPNHTKTFSICLEKQLPVDKTEDKSLEERGRILISLKYSSQKQGLLVGIVRCAHLAAMDANGYSDPYVKTYLRPDVDKKSKHKTAVKKKTLNPEFNEEFCYEIKHGDLAKKSLEVTVWDYDIGKSNDFIGGVVLGIHAKGERLKHWFDCLKNKDKRIERWHTLTSELPGAVLSD

SEQ ID NO: 25494 - protein, 412 aa, Homo sapiens
  Payload ID: 5051
  Gene Symbol: DOC2B
  Gene Name: double C2-like domains, beta
  ENSP ID: ENSP00000482950
MTLRRRGEKATISIQEHMAIDVCPGPIRPIKQISDYFPRFPRGLPPDAGPRAAAPPDAPARPAVAGAGRRSPSDGAREDDEDVDQLFGAYGSSPGPSPGPSPARPPAKPPEDEPDADGYESDDCTALGTLDFSLLYDQENNALHCTITKAKGLKPMDHNGLADPYVKLHLLPGASKANKLRTKTLRNTLNPTWNETLTYYGITDEDMIRKTLRISVCDEDKFRHNEFIGETRVPLKKLKPNHTKTFSICLEKQLPVDKTEDKSLEERGRILISLKYSSQKQGLLVGIVRCAHLAAMDANGYSDPYVKTYLRPDVDKKSKHKTAVKKKTLNPEFNEEFCYEIKHGDLAKKSLEVTVWDYDIGKSNDFIGGVVLGIHAKGERLKHWFDCLKNKDKRIERWHTLTSELPGAVLSD

SEQ ID NO: 25495 - protein, 160 aa, Homo sapiens
  Payload ID: 5052
  Gene Symbol: DUX4
  Gene Name: double homeobox 4
  ENSP ID: ENSP00000455112
MALPTPSDSTLPAEARGRGRRRRLVWTPSQSEALRACFERNPYPGIATRERLAQAIGIPEPRVQIWFQNERSRQLRQHRRESRPWPGRRGPPEGRRKRTAVTGSQTALLLRAFEKDRFPGIAAREELARETGLPESRIQIWFQNRRARHPGQGGRAPAQV

SEQ ID NO: 25496 - protein, 424 aa, Homo sapiens
  Payload ID: 5052
  Gene Symbol: DUX4
  Gene Name: double homeobox 4
  Uniprot ID: Q9UBX2
  ENSP ID: ENSP00000456539
MALPTPSDSTLPAEARGRGRRRRLVWTPSQSEALRACFERNPYPGIATRERLAQAIGIPEPRVQIWFQNERSRQLRQHRRESRPWPGRRGPPEGRRKRTAVTGSQTALLLRAFEKDRFPGIAAREELARETGLPESRIQIWFQNRRARHPGQGGRAPAQAGGLCSAAPGGGHPAPSWVAFAHTGAWGTGLPAPHVPCAPGALPQGAFVSQAARAAPALQPSQAAPAEGISQPAPARGDFAYAAPAPPDGALSHPQAPRWPPHPGKSREDRDPQRDGLPGPCAVAQPGPAQAGPQGQGVLAPPTSQGSPWWGWGRGPQVAGAAWEPQAGAAPPPQPAPPDASASARQGQMQGIPAPSQALQEPAPWSALPCGLLLDELLASPEFLQQAQPLLETEAPGELEASEEAASLEAPLSEEEYRALLEEL

SEQ ID NO: 25497 - protein, 424 aa, Homo sapiens; identical to SEQ ID NO: 25496
  Payload ID: 5052
  Gene Symbol: DUX4
  Gene Name: double homeobox 4
  Uniprot ID: Q9UBX2
  ENSP ID: ENSP00000458065

SEQ ID NO: 25498 - protein, 424 aa, Homo sapiens; identical to SEQ ID NO: 25496
  Payload ID: 5052
  Gene Symbol: DUX4
  Gene Name: double homeobox 4
  Uniprot ID: Q9UBX2
  ENSP ID: ENSP00000483555

SEQ ID NO: 25499 - protein, 204 aa, Homo sapiens
  Payload ID: 5053
  Gene Symbol: DUXA
  Gene Name: double homeobox A
  Uniprot ID: A6NLW8
  ENSP ID: ENSP00000452398
MAEDTYSHKMVKTNHRRCRTKFTEEQLKILINTFNQKPYPGYATKQKLALEINTEESRIQIWFQNRRARHGFQKRPEAETLESSQSQGQDQPGVEFQSREARRCRTTYSASQLHTLIKAFMKNPYPGIDSREELAKEIGVPESRVQIWFQNRRSRLLLQRKREPVASLEQEEQGKIPEGLQGAEDTQNGTNFTSDSHFSGARTW

SEQ ID NO: 25500 - protein, 752 aa, Homo sapiens
  Payload ID: 5054
  Gene Symbol: DZANK1
  Gene Name: double zinc ribbon and ankyrin repeat domains 1
  Uniprot ID: Q9NVP4
  ENSP ID: ENSP00000262547
MTAGSVCVPQIIPLRVPQPGKANHEIDNNTLLEMKSDTPDVNIYYTLDGSKPEFLKRIGYGENNTFKYIKPITLPDGKIQVKAIAVSKDCRQSGIVTKVFHVDYEPPNIVSPEDNVENVLKDSSRQEFKNGFVGSKLKKKYKNSENQRSWNVNLRKFPESPLEIPAYGGGSGSRPPTRQSQSPGFAHVSGQKCLTSTEIMRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 25501 - protein, 462 aa, Homo sapiens
  Payload ID: 5054
  Gene Symbol: DZANK1
  Gene Name: double zinc ribbon and ankyrin repeat domains 1
  ENSP ID: ENSP00000328866
MGLCAECRSLVPMNTPICVVCEAPLALQLQPQASLHLKEKVICRACGTGNPAHLRYCVTCEGALPSSQELGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 25502 - protein, 559 aa, Homo sapiens
  Payload ID: 5054
  Gene Symbol: DZANK1
  Gene Name: double zinc ribbon and ankyrin repeat domains 1
  ENSP ID: ENSP00000349774
MRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSEPRCAWQSLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 25503 - protein, 752 aa, Homo sapiens; identical to SEQ ID NO: 25500
  Payload ID: 5054
  Gene Symbol: DZANK1
  Gene Name: double zinc ribbon and ankyrin repeat domains 1
  Uniprot ID: Q9NVP4
  ENSP ID: ENSP00000351734

SEQ ID NO: 25504 - protein, 247 aa, Homo sapiens
  Payload ID: 5054
  Gene Symbol: DZANK1
  Gene Name: double zinc ribbon and ankyrin repeat domains 1
  ENSP ID: ENSP00000366857
MTAGSVCVPQIIPLRVPQPGKANHEIDNNTLLEMKSDTPDVNIYYTLDGSKPEFLKRIGYGENNTFKYIKPITLPDGKIQVKAIAVSKDCRQSGIVTKVFHVDYEPPNIVSPEDNVENVLKDSSRQEFKNGFVGSKLKKKYKNSENQRSWNVNLRKFPVPRFCTRKRSEVFDKHGDNENSKGDRLSQVCPLPCPPAIRSLCSLLSRMWLSCPTHIWLSSPTPRRSSDGLVCRMQKLGTHEHSHLCGV

SEQ ID NO: 25505 - protein, 189 aa, Homo sapiens
  Payload ID: 5054
  Gene Symbol: DZANK1
  Gene Name: double zinc ribbon and ankyrin repeat domains 1
  ENSP ID: ENSP00000476391
MTAGSVCVPQIIPLRVPQPGKANHEIDNNTLLEMKSDTPDVNIYYTLDGSKPEFLKRIGYGENNTFKYIKPITLPDGKIQVKAIAVSKDCRQSGIVTKVFHVDYEPPNIVSPEDNVENVLKDSSRQEFKNGFVGSKLKKKYKNSENQRSWNVNLRKFPESPLEIPAYGGGSGSRPPTRQSQARHSPIYI

SEQ ID NO: 25506 - protein, 574 aa, Homo sapiens
  Payload ID: 5054
  Gene Symbol: DZANK1
  Gene Name: double zinc ribbon and ankyrin repeat domains 1
  Uniprot ID: Q9NVP4
  ENSP ID: ENSP00000477046
MTAGSVCVPQIIPLRVPQPGKANHEIDNNTLLEMKSDTPDVNIYYTLDGSKPEFLKRIGYGENNTFKYIKPITLPDGKIQVKAIAVSKDCRQSGIVTKVFHVDYEPPNIVSPEDNVENVLKDSSRQEFKNGFVGSKLKKKYKNSENQRSWNVNLRKFPESPLEIPAYGGGSGSRPPTRQSQSPGFAHVSGQKCLTSTEIMRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKVRKLRLREVKQPASSKGTKLVSGRPRIHTWQPETFPS

SEQ ID NO: 25507 - protein, 247 aa, Homo sapiens; identical to SEQ ID NO: 25504
  Payload ID: 5054
  Gene Symbol: DZANK1
  Gene Name: double zinc ribbon and ankyrin repeat domains 1
  ENSP ID: ENSP00000477872

SEQ ID NO: 25508 - protein, 225 aa, Homo sapiens
  Payload ID: 5054
  Gene Symbol: DZANK1
  Gene Name: double zinc ribbon and ankyrin repeat domains 1
  ENSP ID: ENSP00000479439
  MOD_RES (1)..(1): Any amino acid
XTQSLIKDLKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 25509 - protein, 140 aa, Homo sapiens
  Payload ID: 5054
  Gene Symbol: DZANK1
  Gene Name: double zinc ribbon and ankyrin repeat domains 1
  ENSP ID: ENSP00000484666
MSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQL

SEQ ID NO: 25510 - protein, 441 aa, Homo sapiens
  Payload ID: 5055
  Gene Symbol: DCX
  Gene Name: doublecortin
  Uniprot ID: O43602
  ENSP ID: ENSP00000337697
MKTLPLHSHCTEMQRLLPKLEMLTLGSSFCSLQGEFCQAMDSFTTVSHVGMCEETDASFNVFSPKFQFDRSHCQSLRFHQNMELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSANGTSSSQLSTPKSKQSPISTPTSPGSLRKHKDLYLPLSLDDSDSLGDSM

SEQ ID NO: 25511 - protein, 365 aa, Homo sapiens
  Payload ID: 5055
  Gene Symbol: DCX
  Gene Name: doublecortin
  Uniprot ID: O43602
  ENSP ID: ENSP00000348553
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSGNDQDANGTSSSQLSTPKSKQSPISTPTSPGSLRKHKDLYLPLSLDDSDSLGDSM

SEQ ID NO: 25512 - protein, 438 aa, Homo sapiens
  Payload ID: 5055
  Gene Symbol: DCX
  Gene Name: doublecortin
  ENSP ID: ENSP00000350776
  MOD_RES (1)..(1): Any amino acid
XCTEMQRLLPKLEMLTLGSSFCSLQGEFCQAMDSFTTVSHVGMCEETDASFNVFSPKFQFDRSHCQSLRFHQNMELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSGNDQDANGTSSSQLSTPKSKQSPISTPTSPGSLRKHKDLYLPLSLDDSDSLGDSM

SEQ ID NO: 25513 - protein, 360 aa, Homo sapiens
  Payload ID: 5055
  Gene Symbol: DCX
  Gene Name: doublecortin
  Uniprot ID: O43602
  ENSP ID: ENSP00000361061
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSANGTSSSQLSTPKSKQSPISTPTSPGSLRKHKDLYLPLSLDDSDSLGDSM

SEQ ID NO: 25514 - protein, 113 aa, Homo sapiens
  Payload ID: 5055
  Gene Symbol: DCX
  Gene Name: doublecortin
  ENSP ID: ENSP00000418811
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKI

SEQ ID NO: 25515 - protein, 360 aa, Homo sapiens; identical to SEQ ID NO: 25513
  Payload ID: 5055
  Gene Symbol: DCX
  Gene Name: doublecortin
  Uniprot ID: O43602
  ENSP ID: ENSP00000419861

SEQ ID NO: 25516 - protein, 407 aa, Homo sapiens
  Payload ID: 5056
  Gene Symbol: DCDC1
  Gene Name: doublecortin domain containing 1
  ENSP ID: ENSP00000306898
  MOD_RES (1)..(1): Any amino acid
XDGKRKTMLCLACGQSMRTEKGLKQLLPGVPFLCISGTKTQKPFLQGPFKVISVAEVDLSCDKAEKTLSYYQARLLSLRMKTCTQAASHSGMAATHQKAVKIIAYKNGDGYRNGKLIVAGTFPMLLTECTEQLGLARAASKVYTKDGTPIFTLRDLVLWALDESFLQRDSEKQKQDAAPVGKEQIIVESMEENPRMKVKNRLFAKSVTSDSLDGIDKSLLTLILRNPIAIWVSCGEPFLPPNALQKAEKLEKQNWLKKDRILADLDTMRHKMRQLKGRRVAACQPATMVPTKSPVQPVVVEGGWTEQTQQEIKLMELIRHTEAHLSEIQEMESKINFPIATKRIAVKPSNLYKQPNTKRVWIYLNGGRPEDGTYAWGKTISEVSLLYLKTWIFIWSRKVFFYFLITA

SEQ ID NO: 25517 - protein, 270 aa, Homo sapiens
  Payload ID: 5056
  Gene Symbol: DCDC1
  Gene Name: doublecortin domain containing 1
  Uniprot ID: P59894
  ENSP ID: ENSP00000343496
MAKTGAEDHREALSQSSLSLLTEAMEVLQQSSPEGTLDGNTVNPIYKYILNDLPREFMSSQAKAVIKTTDDYLQSQFGPNRLVHSAAVSEGSGLQDCSTHQTASDHSHDEISDLDSYKSNSKNNSCSISASKRNRPVSAPVGQLRVAEFSSLKFQSARNWQKLSQRHKLQPRVIKVTAYKNGSRTVFARVTVPTITLLLEECTEKLNLNMAARRVFLADGKEALEPEDIPHEADVYVSTGEPFLNPFKKIKGFRYLYNKNESKFTSQIFL

SEQ ID NO: 25518 - protein, 890 aa, Homo sapiens
  Payload ID: 5056
  Gene Symbol: DCDC1
  Gene Name: doublecortin domain containing 1
  ENSP ID: ENSP00000385936
MWPVLPSGQLNEEFDWPIQGLLVPSSPPMKKPICKTTEPYAPVRLRVLQNGEKNKNRSVTILGPDISPGRKTQCTEILNLPSAARRLYNEKGKEIFALKDLQRDELVYVSCGELWINPDLSIAQQKKQIFLRNLESDIAKIQIFCSTHKIEALVLEVQSDIVSGSKLAVHKPVAIFGEEKQVTEPEEKQMQEDPLTTENASSEILDSHVRAHLRMKACHTLPRYAWQETSHDFDEDDSLPKKTEKGLFENVEPQKKHSCSPKHSKLHKHCHQQFEYRDGQIISHAAPQLVLGVQGPNLRSGMEVVLVEKKSDGSHQRWIHQEDSRTFHLVSNPDLVLAVSMTKTRNEVCGYPVIVQKYKPYNNGAANQKWHYMKNIKALVAFHSTALDKEITSANYAGVCTSSVIKEENIDQPGYCYLSPDGKRKTMLCLACGQSMRTEKGLKQLLPGVPFLCISGTKTQKPFLQGPFKVISVAEVDLSCDKAEKTLSYYQARLLSLRMKTCTQAASHSGMAATHQKAVKIIAYKNGDGYRNGKLIVAGTFPMLLTECTEQLGLARAASKVYTKDGTPIFTLRDLVLWALDESFLQRDSEKQKQDAAPVGKEQIIVEKNPRMKVKNRLFAKSVTSDSLDGIDKSLLTLILRNPIAIWVSCGEPFLPPNALQKAEKLEKQNWLKKDRILADLDTMRHKMRQLKGRRVAACQPATMVPTKSPVQPVVVEGGWTEQTQQEIKLMELIRHTEAHLSEIQEMESKINFPIATKRIAVKPSNLYKQPNTKRVWIYLNGGRPEDGTYAWGKTISELLQDCSSRLKMTHPARALYTPSGEPIQSWDDIERDMVICVSMGHGFKTPKELKQLMEIRANYARIRRQQGPQATDIVVSPSTKLLSLAHLHN

SEQ ID NO: 25519 - protein, 354 aa, Homo sapiens
  Payload ID: 5056
  Gene Symbol: DCDC1
  Gene Name: doublecortin domain containing 1
  Uniprot ID: P59894
  ENSP ID: ENSP00000389792
MAKTGAEDHREALSQSSLSLLTEAMEVLQQSSPEGTLDGNTVNPIYKYILNDLPREFMSSQAKAVIKTTDDYLQSQFGPNRLVHSAAVSEGSGLQDCSTHQTASDHSHDEISDLDSYKSNSKNNSCSISASKRNRPVSAPVGQLRVAEFSSLKFQSARNWQKLSQRHKLQPRVIKVTAYKNGSRTVFARVTVPTITLLLEECTEKLNLNMAARRVFLADGKEALEPEDIPHEADVYVSTGEPFLNPFKKIKDHLLLIKKVTWTMNGLMLPTDIKRRKTKPVLSIRMKKLTERTSVRILFFKNGMGQDGHEITVGKETMKKVLDTCTIRMNLNLPARYFYDLYGRKIEDISKGKH

SEQ ID NO: 25520 - protein, 818 aa, Homo sapiens
  Payload ID: 5056
  Gene Symbol: DCDC1
  Gene Name: doublecortin domain containing 1
  ENSP ID: ENSP00000404672
  MOD_RES (1)..(1): Any amino acid
XCTEILNLPSAARRLYNEKGKEIFALKDLQRDELVYVSCGELWINPDLSIAQQKKQIFLRNLESDIAKIQIFCSTHKIEALVLEVQSDIVSGSKLAVHKPVAIFGEEKQVTEPEEKQMQEDPLTTENASSEILDSHVRAHLRMKACHTLPRYAWQETSHDFDEDDSLPKKTEKGLFENVEPQKKHSCSPKHSKLHKHCHQQFEYRDGQIISHAAPQLVLGVQGPNLRSGMEVVLVEKKSDGSHQRWIHQEDSRTFHLVSNPDLVLAVSMTKTRNEVCGYPVIVQKYKPYNNGAANQKWHYMKNIKALVAFHSTALDKEITSANYAGVCTSSVIKEENIDQPGYCYLSPDGKRKTMLCLACGQSMRTEKGLKQLLPGVPFLCISGTKTQKPFLQGPFKVISVAEVDLSCDKAEKTLSYYQARLLSLRMKTCTQAASHSGMAATHQKAVKIIAYKNGDGYRNGKLIVAGTFPMLLTECTEQLGLARAASKVYTKDGTPIFTLRDLVLWALDESFLQRDSEKQKQDAAPVGKEQIIVEKNPRMKVKNRLFAKSVTSDSLDGIDKSLLTLILRNPIAIWVSCGEPFLPPNALQKAEKLEKQNWLKKDRILADLDTMRHKMRQLKGRRVAACQPATMVPTKSPVQPVVVEGGWTEQTQQEIKLMELIRHTEAHLSEIQEMESKINFPIATKRIAVKPSNLYKQPNTKRVWIYLNGGRPEDGTYAWGKTISELLQDCSSRLKMTHPARALYTPSGEPIQSWDDIERDMVICVSMGHGFKTPKELKQLMEIRANYARIRRQQGPQATDIVVSPSTKLLSLAHLHN

SEQ ID NO: 25521 - protein, 1783 aa, Homo sapiens
  Payload ID: 5056
  Gene Symbol: DCDC1
  Gene Name: doublecortin domain containing 1
  ENSP ID: ENSP00000472625
MAKTGAEDHREALSQSSLSLLTEAMEVLQQSSPEGTLDGNTVNPIYKYILNDLPREFMSSQAKAVIKTTDDYLQSQFGPNRLVHSAAVSEGSGLQDCSTHQTASDHSHDEISDLDSYKSNSKNNSCSISASKRNRPVSAPVGQLRVAEFSSLKFQSARNWQKLSQRHKLQPRVIKVTAYKNGSRTVFARVTVPTITLLLEECTEKLNLNMAARRVFLADGKEALEPEDIPHEADVYVSTGEPFLNPFKKIKDHLLLIKKVTWTMNGLMLPTDIKRRKTKPVLSIRMKKLTERTSVRILFFKNGMGQDGHEITVGKETMKKVLDTCTIRMNLNLPARYFYDLYGRKIEDISKVPLLEKCLQNSITPLRGLLWVSKGEGFSPSGAKMYIQGVLLALYQRLKSAKKYYKQLNLVMNEQKEKITEKVILSMTAKEHHKEQEEVSRLIDELQTAIKSNIGHLCKLGPQLQAEQEQFSSYVYQHIKSLPANTLVPGGLQLKVFENGKNTGEISVGISKKDLGSDSPIQTDHMMERLLLKIHQRLQGSSINPPGLNYSSMRLFDENGQEIKNPLSLKNEQKIWVSYGRAYRSPLNLALGLTFDRVSAFARGDIMVAYKTFLDPNAVLLPGCGNWEVCEGFPINFNCTSQQIPDQFEKVDLENHFLQNKVDPNIVLHASVSIGKWSFSGSEASSRSQIAPSILWPVASVWLITKTGMILSRAITQGCLAIGHPIRVKAAEGTSLEGYKLILQKRHSGDDSQKWVFGTDGCIYSKAYPQFVLTYLEELNAQVDVTQTEYHIHHGAWTTAHQEHGRNLAEEVLQESASNLGLKQLPEPSDTHLMPEGSLEETGELTVALVRKLEEKHPKASAQRWAIKHEGTSKPGQWKHSRVENPLWNKLTYMWPVLPSGQLNEEFDWPIQGLLVPSSPPMKKPICKTTEPYAPVRLRVLQNGEKNKNRSVTILGPDISPGRKTQCTEILNLPSAARRLYNEKGKEIFALKDLQRDELVYVSCGELWINPDLSIAQQKKQIFLRNLESDIAKIQIFCSTHKIEALVLEVQSDIVSGSKLAVHKPVAIFGEEKQVTEPEEKQMQEDPLTTENASSEILDSHVRAHLRMKACHTLPRYAWQETSHDFDEDDSLPKKTEKGLFENVEPQKKHSCSPKHSKLHKHCHQQFEYRDGQIISHAAPQLVLGVQGPNLRSGMEVVLVEKKSDGSHQRWIHQEDSRTFHLVSNPDLVLAVSMTKTRNEVCGYPVIVQKYKPYNNGAANQKWHYMKNIKALVAFHSTALDKEITSANYAGVCTSSVIKEENIDQPGYCYLSPDGKRKTMLCLACGQSMRTEKGLKQLLPGVPFLCISGTKTQKPFLQGPFKVISVAEVDLSCDKAEKTLSYYQARLLSLRMKTCTQAASHSGMAATHQKAVKIIAYKNGDGYRNGKLIVAGTFPMLLTECTEQLGLARAASKVYTKDGTPIFTLRDLVLWALDESFLQRDSEKQKQDAAPVGKEQIIVEKNPRMKVKNRLFAKSVTSDSLDGIDKSLLTLILRNPIAIWVSCGEPFLPPNALQKAEKLEKQNWLKKDRILADLDTMRHKMRQLKGRRVAACQPATMVPTKSPVQPVVVEGGWTEQTQQEIKLMELIRHTEAHLSEIQEMESKINFPIATKRIAVKPSNLYKQPNTKRVWIYLNGGRPEDGTYAWGKTISELLQDCSSRLKMTHPARALYTPSGEPIQSWDDIERDMVICVSMGHGFKTPKELKQLMEIRANYARIRRQQGPQATDIVVSPSTKLLSLAHLHN

SEQ ID NO: 25522 - protein, 229 aa, Homo sapiens
  Payload ID: 5057
  Gene Symbol: DCDC2
  Gene Name: doublecortin domain containing 2
  Uniprot ID: Q9UHG0
  ENSP ID: ENSP00000367711
MKMWNNWGWCGGRRRGCTKILSTKKGIQMSIKNKHLIVIPAFSHTMSQLDFDFHCVFVSIDEGIFKAGAERSETRGAAEVQEDEDTQVEVPVDQRPAEIVDEEEDGEKANKDAEQKEDFSGMNGDLEEEGGREATDAPEQVEEILDHSEQQARPARVNGGTDEENGEELQQVNNELQLVLDKERKSQGAGSGQDEADVDPQRPPRPEVKITSPEENENNQQNKDYAAVA

SEQ ID NO: 25523 - protein, 476 aa, Homo sapiens
  Payload ID: 5057
  Gene Symbol: DCDC2
  Gene Name: doublecortin domain containing 2
  Uniprot ID: Q9UHG0
  ENSP ID: ENSP00000367715
MSGSSARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLNYLDIGEIKKRPMEVVNTEVKPVIHSRINVSARFRKPLQEPCTIFLIANGDLINPASRLLIPRKTLNQWDHVLQMVTEKITLRSGAVHRLYTLEGKLVESGAELENGQFYVAVGRDKFKKLPYSELLFDKSTMRRPFGQKASSLPPIVGSRKSKGSGNDRHSKSTVGSSDNSSPQPLKRKGKKEDVNSEKLTKLKQNVKLKNSQETIPNSDEGIFKAGAERSETRGAAEVQEDEDTQVEVPVDQRPAEIVDEEEDGEKANKDAEQKEDFSGMNGDLEEEGGREATDAPEQVEEILDHSEQQARPARVNGGTDEENGEELQQVNNELQLVLDKERKSQGAGSGQDEADVDPQRPPRPEVKITSPEENENNQQNKDYAAVA

SEQ ID NO: 25524 - protein, 88 aa, Homo sapiens
  Payload ID: 5057
  Gene Symbol: DCDC2
  Gene Name: doublecortin domain containing 2
  ENSP ID: ENSP00000410939
  MOD_RES (1)..(1): Any amino acid
XVVIHEKKVSSFEVFLKEVTGGVQAPFGAVRNIYTPRTGHRIRKLDQIQSGGNYVAGGQEAFKKLNYLDIGEIKKRPMEVVNTELHVL

SEQ ID NO: 25525 - protein, 349 aa, Homo sapiens
  Payload ID: 5058
  Gene Symbol: DCDC2B
  Gene Name: doublecortin domain containing 2B
  Uniprot ID: A2VCK2
  ENSP ID: ENSP00000386870
MAGGSPAAKRVVVYRNGDPFFPGSQLVVTQRRFPTMEAFLCEVTSAVQAPLAVRALYTPCHGHPVTNLADLKNRGQYVAAGFERFHKLHYLPHRGKDPGGKSCRLQGPPVTRHLCDGAIGRQLPAGAPSYIHVFRNGDLVSPPFSLKLSQAASQDWETVLKLLTEKVKLQSGAVCKLCTLEGLPLSAGKELVTGHYYVAVGEDEFKDLPYLELLVPSPSLPRGCWQPPGSKSRPHRQGAQGHRAQVTQPSPKEPDRIKPSAFYARPQQTIQPRSKLPTLSFPSGVIGVYGAPHRRKETAGALEVADDEDTQTEEPLDQRAAQIVEEALSLENQPGAGAAISASAPALPS

SEQ ID NO: 25526 - protein, 364 aa, Homo sapiens
  Payload ID: 5059
  Gene Symbol: DCDC2C
  Gene Name: doublecortin domain containing 2C
  Uniprot ID: A8MYV0
  ENSP ID: ENSP00000382097
MGTRGPSAPVDTTPAKTIVVYRNGDPFYVGKKFVLSRRRAATFEALLEQLTEQVDVPFGVRRLFTPTRGHRVLGLDALQAGGKYVAAGRERFKELDYIHIVPRKPAKIRKLKEIKPVVHCDINVPSKWQTYHRISRHINVFTNGRLFIPPAKIIIPKFSLSDWDIVLATIGEKVFPLGGVRKLFTMNGHLLGDSKDLQDNHFYVAVGLETFKYFPYWKSPRVPSEVQQRYANVEKNSQRKKKVDSKGKEPCKYDGIPPKTQDSVYYAKEEKKKTLAEPLVQRGAEGDVYKAPTPSKETQGALDVKEEHNVQLEVPVDQRQAEIVKEDEEIHENTPDFEGNKDKEDARLCEDVERKMAREWKPVD

SEQ ID NO: 25527 - protein, 298 aa, Homo sapiens
  Payload ID: 5059
  Gene Symbol: DCDC2C
  Gene Name: doublecortin domain containing 2C
  ENSP ID: ENSP00000403984
RRAATFEALLEQLTEQVDVPFGVRRLFTPTRGHRVLGLDALQAGGKYVAAGRERFKELDYIHIVPRKPAKIRKLKEIKPVVHCDINVPSKWQTYHRISRHINVFTNGRLFIPPAKIIIPKFSLSDWDIVLATIGEKVFPLGGVRKLFTMNGHLLGDSKDLQDNHFYVAVGLETFKYFPYWKSPRVPSEVQQRYANVEKNSQRKKKVDSKGKEPCKYDGIPPKTQDSVYYAKEEKKKTLAEPLVQRGAEGDVYKAPTPSKETQGALDVKEEHNVQLEVPVDQRQAEIVKEDEEIHENTP

SEQ ID NO: 25528 - protein, 729 aa, Homo sapiens
  Payload ID: 5060
  Gene Symbol: DCLK1
  Gene Name: doublecortin-like kinase 1
  Uniprot ID: O15075
  ENSP ID: ENSP00000255448
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIALDHGFTIKRSGSLDYYQQPGMYWIRPPLLIRRGRFSDEDATRM

SEQ ID NO: 25529 - protein, 740 aa, Homo sapiens
  Payload ID: 5060
  Gene Symbol: DCLK1
  Gene Name: doublecortin-like kinase 1
  Uniprot ID: O15075
  ENSP ID: ENSP00000353846
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIATTALDKERQVFRRRRNQDVRSRYKAQPAPPELNSESEDYSPSSSETVRSPNSPF

SEQ ID NO: 25530 - protein, 363 aa, Homo sapiens
  Payload ID: 5060
  Gene Symbol: DCLK1
  Gene Name: doublecortin-like kinase 1
  ENSP ID: ENSP00000369222
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRDLYRPLSSDDLDSVGDSV

SEQ ID NO: 25531 - protein, 433 aa, Homo sapiens
  Payload ID: 5060
  Gene Symbol: DCLK1
  Gene Name: doublecortin-like kinase 1
  Uniprot ID: O15075
  ENSP ID: ENSP00000369223
MLELIEVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIATTALDKERQVFRRRRNQDVRSRYKAQPAPPELNSESEDYSPSSSETVRSPNSPF

SEQ ID NO: 25532 - protein, 422 aa, Homo sapiens
  Payload ID: 5060
  Gene Symbol: DCLK1
  Gene Name: doublecortin-like kinase 1
  Uniprot ID: O15075
  ENSP ID: ENSP00000484452
MLELIEVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIALDHGFTIKRSGSLDYYQQPGMYWIRPPLLIRRGRFSDEDATRM

SEQ ID NO: 25533 - protein, 766 aa, Homo sapiens
  Payload ID: 5061
  Gene Symbol: DCLK2
  Gene Name: doublecortin-like kinase 2
  Uniprot ID: Q8N568
  ENSP ID: ENSP00000296550
MASTRSIELEHFEERDKRPRPGSRRGAPSSSGGSSSSGPKGNGLIPSPAHSAHCSFYRTRTLQALSSEKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVNGTPSSQLSTPKSTKSSSSSPTSPGSFRGLKQISAHGRSSSNVNGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMNTALDKEGQIFCSKHCQDSGRPGMEPISPVPPSVEEIPVPGEAVPAPTPPESPTPHPPPAAPGGERAGTWRRHRD

SEQ ID NO: 25534 - protein, 783 aa, Homo sapiens
  Payload ID: 5061
  Gene Symbol: DCLK2
  Gene Name: doublecortin-like kinase 2
  Uniprot ID: Q8N568
  ENSP ID: ENSP00000303887
MASTRSIELEHFEERDKRPRPGSRRGAPSSSGGSSSSGPKGNGLIPSPAHSAHCSFYRTRTLQALSSEKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVKRGGHYSSAYSTAKSPVNGTPSSQLSTPKSTKSSSSSPTSPGSFRGLKQISAHGRSSSNVNGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMNTALDKEGQIFCSKHCQDSGRPGMEPISPVPPSVEEIPVPGEAVPAPTPPESPTPHPPPAAPGGERAGTWRRHRD

SEQ ID NO: 25535 - protein, 695 aa, Homo sapiens
  Payload ID: 5061
  Gene Symbol: DCLK2
  Gene Name: doublecortin-like kinase 2
  ENSP ID: ENSP00000401916
MASTRSIELEHFEERDKRPRPGSRRGAPSSSGGSSSSGPKGNGLIPSPAHSAHCSFYRTRTLQALSSEKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVNGTPSSQLSTPKSTKSSSSSPTSPGSFRGLKISAHGRSSSNVNGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMFDLTV

SEQ ID NO: 25536 - protein, 765 aa, Homo sapiens
  Payload ID: 5061
  Gene Symbol: DCLK2
  Gene Name: doublecortin-like kinase 2
  Uniprot ID: Q8N568
  ENSP ID: ENSP00000427235
MASTRSIELEHFEERDKRPRPGSRRGAPSSSGGSSSSGPKGNGLIPSPAHSAHCSFYRTRTLQALSSEKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVNGTPSSQLSTPKSTKSSSSSPTSPGSFRGLKISAHGRSSSNVNGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMNTALDKEGQIFCSKHCQDSGRPGMEPISPVPPSVEEIPVPGEAVPAPTPPESPTPHPPPAAPGGERAGTWRRHRD

SEQ ID NO: 25537 - protein, 716 aa, Homo sapiens
  Payload ID: 5061
  Gene Symbol: DCLK2
  Gene Name: doublecortin-like kinase 2
  ENSP ID: ENSP00000489372
MASTRSIELEHFEERDKRPRPGSRRGAPSSSGGSSSSGPKGNGLIPSPAHSAHCSFYRTRTLQALSSEKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVKRGGHYSSAYSTAKSPVNGTPSSQLSTPKSTKSSSSSPTSPGSFRGLKISAHGRSSSNVNGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMVQGHEHGSR

SEQ ID NO: 25538 - protein, 78 aa, Homo sapiens
  Payload ID: 5061
  Gene Symbol: DCLK2
  Gene Name: doublecortin-like kinase 2
  ENSP ID: ENSP00000489465
RSENNLQEDLFDQILAGKLEFPAPYWDNITDSAKDDASQENNMQAEVTGKLKQHFNNALPKQNSTTTGVSVIMFDLTV

SEQ ID NO: 25539 - protein, 648 aa, Homo sapiens
  Payload ID: 5062
  Gene Symbol: DCLK3
  Gene Name: doublecortin-like kinase 3
  Uniprot ID: Q9C098
  ENSP ID: ENSP00000394484
MGKEPLTLKSIQVAVEELYPNKARALTLAQHSRAPSPRLRSRLFSKALKGDHRCGETETPKSCSEVAGCKAAMRHQGKIPEELSLDDRARTQKKWGRGKWEPEPSSKPPREATLEERHARGEKHLGVEIEKTSGEIIRCEKCKRERELQQSLERERLSLGTSELDMGKGPMYDVEKLVRTRSCRRSPEANPASGEEGWKGDSHRSSPRNPTQELRRPSKSMDKKEDRGPEDQESHAQGAAKAKKDLVEVLPVTEEGLREVKKDTRPMSRSKHGGWLLREHQAGFEKLRRTRGEEKEAEKEKKPCMSGGRRMTLRDDQPAKLEKEPKTRPEENKPERPSGRKPRPMGIIAANVEKHYETGRVIGDGNFAVVKECRHRETRQAYAMKIIDKSRLKGKEDMVDSEILIIQSLSHPNIVKLHEVYETDMEIYLILEYVQGGDLFDAIIESVKFPEPDAALMIMDLCKALVHMHDKSIVHRDLKPENLLVQRNEDKSTTLKLADFGLAKHVVRPIFTVCGTPTYVAPEILSEKGYGLEVDMWAAGVILYILLCGFPPFRSPERDQDELFNIIQLGHFEFLPPYWDNISDAAKDLVSRLLVVDPKKRYTAHQVLQHPWIETAGKTNTVKRQKQVSPSSEGHFRSQHKRVVEQVS

SEQ ID NO: 25540 - protein, 373 aa, Homo sapiens
  Payload ID: 5063
  Gene Symbol: DMRT1
  Gene Name: doublesex and mab-3 related transcription factor 1
  Uniprot ID: Q9Y5R6
  ENSP ID: ENSP00000371711
MPNDEAFSKPSTPSEAPHAPGVPPQGRAGGFGKASGALVGAASGSSAGGSSRGGGSGSGASDLGAGSKKSPRLPKCARCRNHGYASPLKGHKRFCMWRDCQCKKCNLIAERQRVMAAQVALRRQQAQEEELGISHPIPLPSAAELLVKRENNGSNPCLMTECSGTSQPPPASVPTTAASEGRMVIQDIPAVTSRGHVENTPDLVSDSTYYSSFYQPSLFPYYNNLYNCPQYSMALAADSASGEVGNPLGGSPVKNSLRGLPGPYVPGQTGNQWQMKNMENRHAMSSQYRMHSYYPPPSYLGQSVPQFFTFEDAPSYPEARASVFSPPSSQDSGLVSLSSSSPISNKSTKAVLECEPASEPSSFTVTPVIEEDE

SEQ ID NO: 25541 - protein, 215 aa, Homo sapiens
  Payload ID: 5063
  Gene Symbol: DMRT1
  Gene Name: doublesex and mab-3 related transcription factor 1
  ENSP ID: ENSP00000454701
MTECSGTSQPPPASVPTTAASEGRMVIQDIPAVTSRGHVENTPDLVSDSTYYSSFYQPSLFPYYNNLYNCPQYSMALAADSASGEVGNPLGGSPVKNSLRGLPGPYVPGQTGNQWQMKNMENRHAMSSQYRMHSYYPPPSYLGQSVPQFFTFEDAPSYPEARASVFSPPSSQDSGLVSLSSSSPISNKSTKAVLECEPASEPSSFTVTPVIEEDE

SEQ ID NO: 25542 - protein, 226 aa, Homo sapiens
  Payload ID: 5064
  Gene Symbol: DMRT2
  Gene Name: doublesex and mab-3 related transcription factor 2
  Uniprot ID: Q9Y5R5
  ENSP ID: ENSP00000259622
MADPQAGSAAGDWEIDVESLELEEDVCGAPRSTPPGPSPPPADGDCEDDEDDDGVDEDAEEEGDGEEAGASPGMPGQPEQRGGPQPRPPLAPQASPAGTGPRERCTPAGGGAEPRKLSRTPKCARCRNHGVVSCLKGHKRFCRWRDCQCANCLLVVERQRVMAAQVALRRQQATEDKKGLSGKQNNFERKAVYQRQVRAPSLLAKSILEVLLGLFYSYYVYIMNHL

SEQ ID NO: 25543 - protein, 405 aa, Homo sapiens
  Payload ID: 5064
  Gene Symbol: DMRT2
  Gene Name: doublesex and mab-3 related transcription factor 2
  ENSP ID: ENSP00000305785
MADPQAGSAAGDWEIDATEDKKGLSGKQNNFERKAVYQRQVRAPSLLAKSILEGYRPIPAETYVGGTFPLPPPVSDRMRKRRAFADKELENIMLEREYKEREMLETSQAAALFLPNRMVPGPDYNSYKSAYSPSPVEPPSKDFCNFLPTCLDLTMQYSGSGNMELISSNVSVATTYRQYPLSSRFLVWPKCGPISDTLLYQQCLLNATTSVQALKPGASWDLKGARVQDGLSAEQDMMPSKLEGSLVLPHTPEIQTTRSDLQGHQAVPERSAFSPPRRNFSPIVDTDSLAAQGHVLTKISKENTRHPLPLRHNPFHSLFQQTLTDKSGPELKTPFVKEAFEETPKKHRECLVKDNQKYTFTIDRCAKDLFVAKQVGTKLSVNEPLSFSVESILKRPSSAITRVSQ

SEQ ID NO: 25544 - protein, 561 aa, Homo sapiens
  Payload ID: 5064
  Gene Symbol: DMRT2
  Gene Name: doublesex and mab-3 related transcription factor 2
  Uniprot ID: Q9Y5R5
  ENSP ID: ENSP00000350865
MADPQAGSAAGDWEIDVESLELEEDVCGAPRSTPPGPSPPPADGDCEDDEDDDGVDEDAEEEGDGEEAGASPGMPGQPEQRGGPQPRPPLAPQASPAGTGPRERCTPAGGGAEPRKLSRTPKCARCRNHGVVSCLKGHKRFCRWRDCQCANCLLVVERQRVMAAQVALRRQQATEDKKGLSGKQNNFERKAVYQRQVRAPSLLAKSILEGYRPIPAETYVGGTFPLPPPVSDRMRKRRAFADKELENIMLEREYKEREMLETSQAAALFLPNRMVPGPDYNSYKSAYSPSPVEPPSKDFCNFLPTCLDLTMQYSGSGNMELISSNVSVATTYRQYPLSSRFLVWPKCGPISDTLLYQQCLLNATTSVQALKPGASWDLKGARVQDGLSAEQDMMPSKLEGSLVLPHTPEIQTTRSDLQGHQAVPERSAFSPPRRNFSPIVDTDSLAAQGHVLTKISKENTRHPLPLRHNPFHSLFQQTLTDKSGPELKTPFVKEAFEETPKKHRECLVKDNQKYTFTIDRCAKDLFVAKQVGTKLSVNEPLSFSVESILKRPSSAITRVSQ

SEQ ID NO: 25545 - protein, 561 aa, Homo sapiens; identical to SEQ ID NO: 25544
  Payload ID: 5064
  Gene Symbol: DMRT2
  Gene Name: doublesex and mab-3 related transcription factor 2
  Uniprot ID: Q9Y5R5
  ENSP ID: ENSP00000371686

SEQ ID NO: 25546 - protein, 226 aa, Homo sapiens; identical to SEQ ID NO: 25542
  Payload ID: 5064
  Gene Symbol: DMRT2
  Gene Name: doublesex and mab-3 related transcription factor 2
  Uniprot ID: Q9Y5R5
  ENSP ID: ENSP00000371690

SEQ ID NO: 25547 - protein, 226 aa, Homo sapiens; identical to SEQ ID NO: 25542
  Payload ID: 5064
  Gene Symbol: DMRT2
  Gene Name: doublesex and mab-3 related transcription factor 2
  Uniprot ID: Q9Y5R5
  ENSP ID: ENSP00000397494

SEQ ID NO: 25548 - protein, 226 aa, Homo sapiens; identical to SEQ ID NO: 25542
  Payload ID: 5064
  Gene Symbol: DMRT2
  Gene Name: doublesex and mab-3 related transcription factor 2
  ENSP ID: ENSP00000489226

SEQ ID NO: 25549 - protein, 472 aa, Homo sapiens
  Payload ID: 5065
  Gene Symbol: DMRT3
  Gene Name: doublesex and mab-3 related transcription factor 3
  Uniprot ID: Q9NQL9
  ENSP ID: ENSP00000190165
MNGYGSPYLYMGGPVSQPPRAPLQRTPKCARCRNHGVLSWLKGHKRYCRFKDCTCEKCILIIERQRVMAAQVALRRQQANESLESLIPDSLRALPGPPPPGDAVAAPQPPPASQPSQPQPPRPAAELAAAAALRWTAEPQPGALQAQLAKPDLTEERLGDGKSADNTEVFSDKDTDQRSSPDVAKSKGCFTPESPEIVSVEEGGYAVQKNGGNPESRPDSPKCHAEQNHLLIEGPSGTVSLPFSLKANRPPLEVLKKIFPNQKPTVLELILKGCGGDLVSAVEVLLSSRSSVTGAERTSAEPESLALPSNGHIFEHTLSSYPISSSKWSVGSAFRVPDTLRFSADSSNVVPSPLAGPLQPPFPQPPRYPLMLRNTLARSQSSPFLPNDVTLWNTMTLQQQYQLRSQYVSPFPSNSTSVFRSSPVLPARATEDPRISIPDDGCPFVSKQSIYTEDDYDERSDSSDSRTLNTSS

SEQ ID NO: 25550 - protein, 112 aa, Homo sapiens
  Payload ID: 5065
  Gene Symbol: DMRT3
  Gene Name: doublesex and mab-3 related transcription factor 3
  ENSP ID: ENSP00000387472
MHTRKRLTQLFCFPDLTEERLGDGKSADNTEVFSDKDTDQRSSPDVAKSKGCFTPESPEIVSVEEGGYAVQKNGGNPESRPDSPKCHAEQNHLLIEGPSGTVSLPFSLKANR

SEQ ID NO: 25551 - protein, 2012 aa, Homo sapiens
  Payload ID: 5066
  Gene Symbol: DSCAM
  Gene Name: Down syndrome cell adhesion molecule
  Uniprot ID: O60469
  ENSP ID: ENSP00000383303
MWILALSLFQSFANVFSEDLHSSLYFVNASLQEVVFASTTGTLVPCPAAGIPPVTLRWYLATGEEIYDVPGIRHVHPNGTLQIFPFPPSSFSTLIHDNTYYCTAENPSGKIRSQDVHIKAVLREPYTVRVEDQKTMRGNVAVFKCIIPSSVEAYITVVSWEKDTVSLVSGSRFLITSTGALYIKDVQNEDGLYNYRCITRHRYTGETRQSNSARLFVSDPANSAPSILDGFDHRKAMAGQRVELPCKALGHPEPDYRWLKDNMPLELSGRFQKTVTGLLIENIRPSDSGSYVCEVSNRYGTAKVIGRLYVKQPLKATISPRKVKSSVGSQVSLSCSVTGTEDQELSWYRNGEILNPGKNVRITGINHENLIMDHMVKSDGGAYQCFVRKDKLSAQDYVQVVLEDGTPKIISAFSEKVVSPAEPVSLMCNVKGTPLPTITWTLDDDPILKGGSHRISQMITSEGNVVSYLNISSSQVRDGGVYRCTANNSAGVVLYQARINVRGPASIRPMKNITAIAGRDTYIHCRVIGYPYYSIKWYKNSNLLPFNHRQVAFENNGTLKLSDVQKEVDEGEYTCNVLVQPQLSTSQSVHVTVKVPPFIQPFEFPRFSIGQRVFIPCVVVSGDLPITITWQKDGRPIPGSLGVTIDNIDFTSSLRISNLSLMHNGNYTCIARNEAAAVEHQSQLIVRVPPKFVVQPRDQDGIYGKAVILNCSAEGYPVPTIVWKFSKGAGVPQFQPIALNGRIQVLSNGSLLIKHVVEEDSGYYLCKVSNDVGADVSKSMYLTVKIPAMITSYPNTTLATQGQKKEMSCTAHGEKPIIVRWEKEDRIINPEMARYLVSTKEVGEEVISTLQILPTVREDSGFFSCHAINSYGEDRGIIQLTVQEPPDPPEIEIKDVKARTITLRWTMGFDGNSPITGYDIECKNKSDSWDSAQRTKDVSPQLNSATIIDIHPSSTYSIRMYAKNRIGKSEPSNELTITADEAAPDGPPQEVHLEPISSQSIRVTWKAPKKHLQNGIIRGYQIGYREYSTGGNFQFNIISVDTSGDSEVYTLDNLNKFTQYGLVVQACNRAGTGPSSQEIITTTLEDVPSYPPENVQAIATSPESISISWSTLSKEALNGILQGFRVIYWANLMDGELGEIKNITTTQPSLELDGLEKYTNYSIQVLAFTRAGDGVRSEQIFTRTKEDVPGPPAGVKAAAASASMVFVSWLPPLKLNGIIRKYTVFCSHPYPTVISEFEASPDSFSYRIPNLSRNRQYSVWVVAVTSAGRGNSSEIITVEPLAKAPARILTFSGTVTTPWMKDIVLPCKAVGDPSPAVKWMKDSNGTPSLVTIDGRRSIFSNGSFIIRTVKAEDSGYYSCIANNNWGSDEIILNLQVQVPPDQPRLTVSKTTSSSITLSWLPGDNGGSSIRGYILQYSEDNSEQWGSFPISPSERSYRLENLKCGTWYKFTLTAQNGVGPGRISEIIEAKTLGKEPQFSKEQELFASINTTRVRLNLIGWNDGGCPITSFTLEYRPFGTTVWTTAQRTSLSKSYILYDLQEATWYELQMRVCNSAGCAEKQANFATLNYDGSTIPPLIKSVVQNEEGLTTNEGLKMLVTISCILVGVLLLFVLLLVVRRRRREQRLKRLRDAKSLAEMLMSKNTRTSDTLSKQQQTLRMHIDIPRAQLLIEERDTMETIDDRSTVLLTDADFGEAAKQKSLTVTHTVHYQSVSQATGPLVDVSDARPGTNPTTRRNAKAGPTARNRYASQWTLNRPHPTISAHTLTTDWRLPTPRAAGSVDKESDSYSVSPSQDTDRARSSMVSTESASSTYEELARAYEHAKMEEQLRHAKFTITECFISDTSSEQLTAGTNEYTDSLTSSTPSESGICRFTASPPKPQDGGRVMNMAVPKAHRPGDLIHLPPYLRMDFLLNRGGPGTSRDLSLGQACLEPQKSRTLKRPTVLEPIPMEAASSASSTREGQSWQPGAVATLPQREGAELGQAAKMSSSQESLLDSRGHLKGNNPYAKSYTLV

SEQ ID NO: 25552 - protein, 1746 aa, Homo sapiens
  Payload ID: 5066
  Gene Symbol: DSCAM
  Gene Name: Down syndrome cell adhesion molecule
  ENSP ID: ENSP00000385342
LGHPEPDYRWLKDNMPLELSGRFQKTVTGLLIENIRPSDSGSYVCEVSNRYGTAKVIGRLYVKQPLKATISPRKVKSSVGSQVSLSCSVTGTEDQELSWYRNGEILNPGKNVRITGINHENLIMDHMVKSDGGAYQCFVRKDKLSAQDYVQVVLEDGTPKIISAFSEKVVSPAEPVSLMCNVKGTPLPTITWTLDDDPILKGGSHRISQMITSEGNVVSYLNISSSQVRDGGVYRCTANNSAGVVLYQARINVRGPASIRPMKNITAIAGRDTYIHCRVIGYPYYSIKWYKNSNLLPFNHRQVAFENNGTLKLSDVQKEVDEGEYTCNVLVQPQLSTSQSVHVTVKVPPFIQPFEFPRFSIGQRVFIPCVVVSGDLPITITWQKDGRPIPGSLGVTIDNIDFTSSLRISNLSLMHNGNYTCIARNEAAAVEHQSQLIVRVPPKFVVQPRDQDGIYGKAVILNCSAEGYPVPTIVWKFSKGAGVPQFQPIALNGRIQVLSNGSLLIKHVVEEDSGYYLCKVSNDVGADVSKSMYLTVKIPAMITSYPNTTLATQGQKKEMSCTAHGEKPIIVRWEKEDRIINPEMARYLVSTKEVGEEVISTLQILPTVREDSGFFSCHAINSYGEDRGIIQLTVQEPPDPPEIEIKDVKARTITLRWTMGFDGNSPITGYDIECKNKSDSWDSAQRTKDVSPQLNSATIIDIHPSSTYSIRMYAKNRIGKSEPSNELTITADEAAPDGPPQEVHLEPISSQSIRVTWKAPKKHLQNGIIRGYQIGYREYSTGGNFQFNIISVDTSGDSEVYTLDNLNKFTQYGLVVQACNRAGTGPSSQEIITTTLEDVPSYPPENVQAIATSPESISISWSTLSKEALNGILQGFRVIYWANLMDGELGEIKNITTTQPSLELDGLEKYTNYSIQVLAFTRAGDGVRSEQIFTRTKEDVPGPPAGVKAAAASASMVFVSWLPPLKLNGIIRKYTVFCSHPYPTVISEFEASPDSFSYRIPNLSRNRQYSVWVVAVTSAGRGNSSEIITVEPLAKAPARILTFSGTVTTPWMKDIVLPCKAVGDPSPAVKWMKDSNGTPSLVTIDGRRSIFSNGSFIIRTVKAEDSGYYSCIANNNWGSDEIILNLQVQVPPDQPRLTVSKTTSSSITLSWLPGDNGGSSIRGYILQYSEDNSEQWGSFPISPSERSYRLENLKCGTWYKFTLTAQNGVGPGRISEIIEAKTLGKEPQFSKEQELFASINTTRVRLNLIGWNDGGCPITSFTLEYRPFGTTVWTTAQRTSLSKSYILYDLQEATWYELQMRVCNSAGCAEKQANFATLNYDGSTIPPLIKSVVQNEEGLTTNEGLKMLVTISCILVGVLLLFVLLLVVRRRRREQRLKRLRDAKSLAEMLMSKNTRTSDTLSKQQQTLRMHIDIPRAQLLIEERDTMETIDDRSTVLLTDADFGEAAKQKSLTVTHTVHYQSVSQATGPLVDVSDARPGTNPTTRRNAKAGPTARNRYASQWTLNRPHPTISAHTLTTDWRLPTPRAAGSVDKESDSYSVSPSQDTDRARSSMVSTESASSTYEELARAYEHAKMEEQLRHAKFTITECFISDTSSEQLTAGTNEYTDSLTSSTPSESGICRFTASPPKPQDGGRVMNMAVPKAHRPGGPGTSRDLSLGQACLEPQKSRTLKRPTVLEPIPMEAASSASSTREGQSWQPGAVATLPQREGAELGQAAKMSSSQESLLDSRGHLKGNNPYAKSYTLV

SEQ ID NO: 25553 - protein, 1847 aa, Homo sapiens
  Payload ID: 5066
  Gene Symbol: DSCAM
  Gene Name: Down syndrome cell adhesion molecule
  ENSP ID: ENSP00000478698
SSISGSRFLITSTGALYIKDVQNEDGLYNYRCITRHRYTGETRQSNSARLFVSDPANSAPSILDGFDHRKAMAGQRVELPCKALGHPEPDYRWLKDNMPLELSGRFQKTVTGLLIENIRPSDSGSYVCEVSNRYGTAKVIGRLYVKQPLKATISPRKVKSSVGSQVSLSCSVTGTEDQELSWYRNGEILNPGKNVRITGINHENLIMDHMVKSDGGAYQCFVRKDKLSAQDYVQVVLEDGTPKIISAFSEKVVSPAEPVSLMCNVKGTPLPTITWTLDDDPILKGGSHRISQMITSEGNVVSYLNISSSQVRDGGVYRCTANNSAGVVLYQARINVRGPASIRPMKNITAIAGRDTYIHCRVIGYPYYSIKWYKNSNLLPFNHRQVAFENNGTLKLSDVQKEVDEGEYTCNVLVQPQLSTSQSVHVTVKVPPFIQPFEFPRFSIGQRVFIPCVVVSGDLPITITWQKDGRPIPGSLGVTIDNIDFTSSLRISNLSLMHNGNYTCIARNEAAAVEHQSQLIVRVPPKFVVQPRDQDGIYGKAVILNCSAEGYPVPTIVWKFSKGAGVPQFQPIALNGRIQVLSNGSLLIKHVVEEDSGYYLCKVSNDVGADVSKSMYLTVKIPAMITSYPNTTLATQGQKKEMSCTAHGEKPIIVRWEKEDRIINPEMARYLVSTKEVGEEVISTLQILPTVREDSGFFSCHAINSYGEDRGIIQLTVQEPPDPPEIEIKDVKARTITLRWTMGFDGNSPITGYDIECKNKSDSWDSAQRTKDVSPQLNSATIIDIHPSSTYSIRMYAKNRIGKSEPSNELTITADEAAPDGPPQEVHLEPISSQSIRVTWKAPKKHLQNGIIRGYQIGYREYSTGGNFQFNIISVDTSGDSEVYTLDNLNKFTQYGLVVQACNRAGTGPSSQEIITTTLEDVPSYPPENVQAIATSPESISISWSTLSKEALNGILQGFRVIYWANLMDGELGEIKNITTTQPSLELDGLEKYTNYSIQVLAFTRAGDGVRSEQIFTRTKEDVPGPPAGVKAAAASASMVFVSWLPPLKLNGIIRKYTVFCSHPYPTVISEFEASPDSFSYRIPNLSRNRQYSVWVVAVTSAGRGNSSEIITVEPLAKAPARILTFSGTVTTPWMKDIVLPCKAVGDPSPAVKWMKDSNGTPSLVTIDGRRSIFSNGSFIIRTVKAEDSGYYSCIANNNWGSDEIILNLQVQVPPDQPRLTVSKTTSSSITLSWLPGDNGGSSIRGYILQYSEDNSEQWGSFPISPSERSYRLENLKCGTWYKFTLTAQNGVGPGRISEIIEAKTLGKEPQFSKEQELFASINTTRVRLNLIGWNDGGCPITSFTLEYRPFGTTVWTTAQRTSLSKSYILYDLQEATWYELQMRVCNSAGCAEKQANFATLNYDGSTIPPLIKSVVQNEEGLTTNEGLKMLVTISCILVGVLLLFVLLLVVRRRRREQRLKRLRDAKSLAEMLMSKNTRTSDTLSKQQQTLRMHIDIPRAQLLIEERDTMETIDDRSTVLLTDADFGEAAKQKSLTVTHTVHYQSVSQATGPLVDVSDARPGTNPTTRRNAKAGPTARNRYASQWTLNRPHPTISAHTLTTDWRLPTPRAAGSVDKESDSYSVSPSQDTDRARSSMVSTESASSTYEELARAYEHAKMEEQLRHAKFTITECFISDTSSEQLTAGTNEYTDSLTSSTPSESGICRFTASPPKPQDGGRVMNMAVPKAHRPGDLIHLPPYLRMDFLLNRGGPGTSRDLSLGQACLEPQKSRTLKRPTVLEPIPMEAASSASSTREGQSWQPGAVATLPQREGAELGQAAKMSSSQESLLDSRGHLKGNNPYAKSYTLV

SEQ ID NO: 25554 - protein, 2113 aa, Homo sapiens
  Payload ID: 5067
  Gene Symbol: DSCAML1
  Gene Name: Down syndrome cell adhesion molecule like 1
  Uniprot ID: Q8TD84
  ENSP ID: ENSP00000315465
MTGAGEPRREEPPPQPSAGLRSRESGAPSAGGWERAERGRGAAARPATGPPPRRIGPLYGMWLVTFLLLLDSLHKARPEDVGTSLYFVNDSLQQVTFSSSVGVVVPCPAAGSPSAALRWYLATGDDIYDVPHIRHVHANGTLQLYPFSPSAFNSFIHDNDYFCTAENAAGKIRSPNIRVKAVFREPYTVRVEDQRSMRGNVAVFKCLIPSSVQEYVSVVSWEKDTVSIIPEHRFFITYHGGLYISDVQKEDALSTYRCITKHKYSGETRQSNGARLSVTDPAESIPTILDGFHSQEVWAGHTVELPCTASGYPIPAIRWLKDGRPLPADSRWTKRITGLTISDLRTEDSGTYICEVTNTFGSAEATGILMVIDPLHVTLTPKKLKTGIGSTVILSCALTGSPEFTIRWYRNTELVLPDEAISIRGLSNETLLITSAQKSHSGAYQCFATRKAQTAQDFAIIALEDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGPPSIRAMRNITAVAGRDTLINCRVIGYPYYSIKWYKDALLLPDNHRQVVFENGTLKLTDVQKGMDEGEYLCSVLIQPQLSISQSVHVAVKVPPLIQPFEFPPASIGQLLYIPCVVSSGDMPIRITWRKDGQVIISGSGVTIESKEFMSSLQISSVSLKHNGNYTCIASNAAATVSRERQLIVRVPPRFVVQPNNQDGIYGKAGVLNCSVDGYPPPKVMWKHAKGSGNPQQYHPVPLTGRIQILPNSSLLIRHVLEEDIGYYLCQASNGVGTDISKSMFLTVKIPAMITSHPNTTIAIKGHAKELNCTARGERPIIIRWEKGDTVIDPDRVMRYAIATKDNGDEVVSTLKLKPADRGDSVFFSCHAINSYGEDRGLIQLTVQEPPDPPELEIREVKARSMNLRWTQRFDGNSIITGFDIEYKNKSDSWDFKQSTRNISPTINQANIVDLHPASVYSIRMYSFNKIGRSEPSKELTISTEEAAPDGPPMDVTLQPVTSQSIQVTWKAPKKELQNGVIRGYQIGYRENSPGSNGQYSIVEMKATGDSEVYTLDNLKKFAQYGVVVQAFNRAGTGPSSSEINATTLEDVPSQPPENVRALSITSDVAVISWSEPPRSTLNGVLKGYRVIFWSLYVDGEWGEMQNITTTRERVELRGMEKFTNYSVQVLAYTQAGDGVRSSVLYIQTKEDVPGPPAGIKAVPSSASSVVVSWLPPTKPNGVIRKYTIFCSSPGSGQPAPSEYETSPEQLFYRIAHLNRGQQYLLWVAAVTSAGRGNSSEKVTIEPAGKAPAKIISFGGTVTTPWMKDVRLPCNSVGDPAPAVKWTKDSEDSAIPVSMDGHRLIHTNGTLLLRAVKAEDSGYYTCTATNTGGFDTIIVNLLVQVPPDQPRLTVSKTSASSITLTWIPGDNGGSSIRGFVLQYSVDNSEEWKDVFISSSERSFKLDSLKCGTWYKVKLAAKNSVGSGRISEIIEAKTHGREPSFSKDQHLFTHINSTHARLNLQGWNNGGCPITAIVLEYRPKGTWAWQGLRANSSGEVFLTELREATWYELRMRACNSAGCGNETAQFATLDYDGSTIPPIKSAQGEGDDVKKLFTIGCPVILATLGVALLFIVRKKRKEKRLKRLRDAKSLAEMLISKNNRSFDTPVKGPPQGPRLHIDIPRVQLLIEDKEGIKQLGDDKATIPVTDAEFSQAVNPQSFCTGVSLHHPTLIQSTGPLIDMSDIRPGTNPVSRKNVKSAHSTRNRYSSQWTLTKCQASTPARTLTSDWRTVGSQHGVTVTESDSYSASLSQDTDKGRNSMVSTESASSTYEELARAYEHAKLEEQLQHAKFEITECFISDSSSDQMTTGTNENADSMTSMSTPSEPGICRFTASPPKPQDADRGKNVAVPIPHRANKSDYCNLPLYAKSEAFFRKADGREPCPVVPPREASIRNLARTYHTQARHLTLDPASKSLGLPHPGAPAAASTATLPQRTLAMPAPPAGTAPPAPGPTPAEPPTAPSAAPPAPSTEPPRAGGPHTKMGGSRDSLLEMSTSGVGRSQKQGAGAYSKSYTLV

SEQ ID NO: 25555 - protein, 1843 aa, Homo sapiens
  Payload ID: 5067
  Gene Symbol: DSCAML1
  Gene Name: Down syndrome cell adhesion molecule like 1
  ENSP ID: ENSP00000434335
MWLVTFLLLLDSLHKARPEDVGTSLYFVNDSLQQLPCTASGYPIPAIRWLKDGRPLPADSRWTKRITGLTISDLRTEDSGTYICEVTNTFGSAEATGILMVIDPLHVTLTPKKLKTGIGSTVILSCALTGSPEFTIRWYRNTELVLPDEAISIRGLSNETLLITSAQKSHSGAYQCFATRKAQTAQDFAIIALEDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGPPSIRAMRNITAVAGRDTLINCRVIGYPYYSIKWYKDALLLPDNHRQVVFENGTLKLTDVQKGMDEGEYLCSVLIQPQLSISQSVHVAVKVPPLIQPFEFPPASIGQLLYIPCVVSSGDMPIRITWRKDGQVIISGSGVTIESKEFMSSLQISSVSLKHNGNYTCIASNAAATVSRERQLIVRVPPRFVVQPNNQDGIYGKAGVLNCSVDGYPPPKVMWKHAKGSGNPQQYHPVPLTGRIQILPNSSLLIRHVLEEDIGYYLCQASNGVGTDISKSMFLTVKIPAMITSHPNTTIAIKGHAKELNCTARGERPIIIRWEKGDTVIDPDRVMRYAIATKDNGDEVVSTLKLKPADRGDSVFFSCHAINSYGEDRGLIQLTVQEPPDPPELEIREVKARSMNLRWTQRFDGNSIITGFDIEYKNKSDSWDFKQSTRNISPTINQANIVDLHPASVYSIRMYSFNKIGRSEPSKELTISTEEAAPDGPPMDVTLQPVTSQSIQVTWKAPKKELQNGVIRGYQIGYRENSPGSNGQYSIVEMKATGDSEVYTLDNLKKFAQYGVVVQAFNRAGTGPSSSEINATTLEDVPSQPPENVRALSITSDVAVISWSEPPRSTLNGVLKGYRVIFWSLYVDGEWGEMQNITTTRERVELRGMEKFTNYSVQVLAYTQAGDGVRSSVLYIQTKEDVPGPPAGIKAVPSSASSVVVSWLPPTKPNGVIRKYTIFCSSPGSGQPAPSEYETSPEQLFYRIAHLNRGQQYLLWVAAVTSAGRGNSSEKVTIEPAGKAPAKIISFGGTVTTPWMKDVRLPCNSVGDPAPAVKWTKDSEDSAIPVSMDGHRLIHTNGTLLLRAVKAEDSGYYTCTATNTGGFDTIIVNLLVQVPPDQPRLTVSKTSASSITLTWIPGDNGGSSIRGFVLQYSVDNSEEWKDVFISSSERSFKLDSLKCGTWYKVKLAAKNSVGSGRISEIIEAKTHGREPSFSKDQHLFTHINSTHARLNLQGWNNGGCPITAIVLEYRPKGTWAWQGLRANSSGEVFLTELREATWYELRMRACNSAGCGNETAQFATLDYDGSTIPPIKSAQGEGDDVKKLFTIGCPVILATLGVALLFIVRKKRKEKRLKRLRDAKSLAEMLISKNNRSFDTPVKGPPQGPRLHIDIPRVQLLIEDKEGIKQLGDDKATIPVTDAEFSQAVNPQSFCTGVSLHHPTLIQSTGPLIDMSDIRPGTNPVSRKNVKSAHSTRNRYSSQWTLTKCQASTPARTLTSDWRTVGSQHGVTVTESDSYSASLSQDTDKGRNSMVSTESASSTYEELARAYEHAKLEEQLQHAKFEITECFISDSSSDQMTTGTNENADSMTSMSTPSEPGICRFTASPPKPQDADRGKNVAVPIPHRANKSDYCNLPLYAKSEAFFRKADGREPCPVVPPREASIRNLARTYHTQARHLTLDPASKSLGLPHPGAPAAASTATLPQRTLAMPAPPAGTAPPAPGPTPAEPPTAPSAAPPAPSTEPPRAGGPHTKMGGSRDSLLEMSTSGVGRSQKQGAGAYSKSYTLV

SEQ ID NO: 25556 - protein, 66 aa, Homo sapiens
  Payload ID: 5067
  Gene Symbol: DSCAML1
  Gene Name: Down syndrome cell adhesion molecule like 1
  ENSP ID: ENSP00000436387
MTTSAPRRTLPARSGAPTSASKQFSGNPTPSGWRIKGQCVATWPSSSASSPLQCRNMLALYLGRKT

SEQ ID NO: 25557 - protein, 297 aa, Homo sapiens
  Payload ID: 5068
  Gene Symbol: DSCR3
  Gene Name: Down syndrome critical region 3
  Uniprot ID: O14972
  ENSP ID: ENSP00000311399
MGTALDIKIKRANKVYHAGEVLSGVVVISSKDSVQHQGVSLTMEGTVNLQLSAKSVGVFEAFYNSVKPIQIINSTIEMVKPGKFPSGKTEIPFEFPLHLKGNKVLYETYHGVFVNIQYTLRCDMKRSLLAKDLTKTCEFIVHSAPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 25558 - protein, 249 aa, Homo sapiens
  Payload ID: 5068
  Gene Symbol: DSCR3
  Gene Name: Down syndrome critical region 3
  ENSP ID: ENSP00000381964
MGTALDIKIKRANKVYHAGPIQIINSTIEMVKPGKFPSGKTEIPFEFPLHLKGNKVLYETYHGVFVNIQYTLRCDMKRSLLAKDLTKTCEFIVHSAPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 25559 - protein, 172 aa, Homo sapiens
  Payload ID: 5068
  Gene Symbol: DSCR3
  Gene Name: Down syndrome critical region 3
  ENSP ID: ENSP00000381967
MGTALDIKIKRANKVYHAGPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 25560 - protein, 270 aa, Homo sapiens
  Payload ID: 5068
  Gene Symbol: DSCR3
  Gene Name: Down syndrome critical region 3
  Uniprot ID: O14972
  ENSP ID: ENSP00000419496
MGTALDIKIKRANKVYHAGEVLSGVVVISSKDSVQHQGVSLTMEGTVNLQLSAKSVGVFEAFYNSVKPIQIINSTIEMVKPGKFPSGKTEIPFEFPLHLKGNKVLYETYHGVFVNIQPQKGKFTPSPVDFTITPETLQNVKERALLPKFLLRGHLNSTNCVITQPLTGELVVESSEAAIRSVELQLVRVETCGCAEGYARDATEIQNIQIADGDVCRGLSVPIYMVFPRLFTCPTLETTNFKVEFEVNIVVLLHPDHLITENFPLKLCRI

SEQ ID NO: 25561 - protein, 118 aa, Homo sapiens
  Payload ID: 5069
  Gene Symbol: DSCR4
  Gene Name: Down syndrome critical region 4
  Uniprot ID: P56555
  ENSP ID: ENSP00000328676
MSLIILTRDDEPRIFTPDSDAASPALHSTSPLPDPASASPLHREEKILPKVCNIVSCLSFSLPASPTDSGLASPTIITREGQQFWAKCLIWKYQLYLHGLHKKSDGRRDKQISASPST

SEQ ID NO: 25562 - protein, 127 aa, Homo sapiens
  Payload ID: 5069
  Gene Symbol: DSCR4
  Gene Name: Down syndrome critical region 4
  ENSP ID: ENSP00000381921
MSLIILTRDDEPRIFTPDSDAASPALHSTSPLPDPASASPLHREEKILPKVCNIVSCLSFSLPASPTDSGLASPTIIRDPVASKSQLELSSRPAKTEPRAWSAQFGRCSAQPQPQVDFLPAENTCSG

SEQ ID NO: 25563 - protein, 79 aa, Homo sapiens
  Payload ID: 5069
  Gene Symbol: DSCR4
  Gene Name: Down syndrome critical region 4
  ENSP ID: ENSP00000434191
MSLIILTRDDEPRIFTPDSDAASPALHSTSPLPDPASASPLHREEKILPKVCNIVSCLSFSLPASPTDSGLASPTIISW

SEQ ID NO: 25564 - protein, 97 aa, Homo sapiens
  Payload ID: 5070
  Gene Symbol: DSCR8
  Gene Name: Down syndrome critical region 8
  Uniprot ID: Q96T75
  ENSP ID: ENSP00000350336
MKEPGPNFVTVRKGLHSFKMAFVKHLLLFLSPRLECSGSITDHCSLHLPVQEILMSQPPEQLGLQTNLGNQESSGMMKLFMPRPKVLAQYESIQFMP

SEQ ID NO: 25565 - protein, 91 aa, Homo sapiens
  Payload ID: 5070
  Gene Symbol: DSCR8
  Gene Name: Down syndrome critical region 8
  Uniprot ID: Q96T75
  ENSP ID: ENSP00000383325
MKEPGPNFVTVRKGLHSFKMAFVKHLLLECSGSITDHCSLHLPVQEILMSQPPEQLGLQTNLGNQESSGMMKLFMPRPKVLAQYESIQFMP

SEQ ID NO: 25566 - protein, 97 aa, Homo sapiens; identical to SEQ ID NO: 25564
  Payload ID: 5070
  Gene Symbol: DSCR8
  Gene Name: Down syndrome critical region 8
  Uniprot ID: Q96T75
  ENSP ID: ENSP00000480061

SEQ ID NO: 25567 - protein, 176 aa, Homo sapiens
  Payload ID: 5071
  Gene Symbol: DR1
  Gene Name: down-regulator of transcription 1
  Uniprot ID: Q01658
  ENSP ID: ENSP00000359290
MASSSGNDDDLTIPRAAINKMIKETLPNVRVANDARELVVNCCTEFIHLISSEANEICNKSEKKTISPEHVIQALESLGFGSYISEVKEVLQECKTVALKRRKASSRLENLGIPEEELLRQQQELFAKARQQQAELAQQEWLQMQQAAQQAQLAAASASASNQAGSSQDEEDDDDI

SEQ ID NO: 25568 - protein, 176 aa, Homo sapiens; identical to SEQ ID NO: 25567
  Payload ID: 5071
  Gene Symbol: DR1
  Gene Name: down-regulator of transcription 1
  Uniprot ID: Q01658
  ENSP ID: ENSP00000359295

SEQ ID NO: 25569 - protein, 552 aa, Homo sapiens
  Payload ID: 5072
  Gene Symbol: DONSON
  Gene Name: downstream neighbor of SON
  ENSP ID: ENSP00000304716
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKARSVNVKTQALSGYRDQFSLEITGPIMPHSLHSLTMLLKSSQSGSFSAVLYPHEPTAVFNICLQMDKVLDMEVVHKELTNCGLHPNTLEQLSQIPLLGKSSLRNVVLRDYIYNWRS

SEQ ID NO: 25570 - protein, 566 aa, Homo sapiens
  Payload ID: 5072
  Gene Symbol: DONSON
  Gene Name: downstream neighbor of SON
  Uniprot ID: Q9NYP3
  ENSP ID: ENSP00000307143
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKARSVNVKTQALSGYRDQFSLEITGPIMPHSLHSLTMLLKSSQSGSFSAVLYPHEPTAVFNICLQMDKVLDMEVVHKELTNCGLHPNTLEQLSQIPLLGKSSLRNVVLRDYIYNWRS

SEQ ID NO: 25571 - protein, 136 aa, Homo sapiens
  Payload ID: 5072
  Gene Symbol: DONSON
  Gene Name: downstream neighbor of SON
  ENSP ID: ENSP00000392014
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQII

SEQ ID NO: 25572 - protein, 158 aa, Homo sapiens
  Payload ID: 5072
  Gene Symbol: DONSON
  Gene Name: downstream neighbor of SON
  ENSP ID: ENSP00000392405
FLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWHGV

SEQ ID NO: 25573 - protein, 508 aa, Homo sapiens
  Payload ID: 5072
  Gene Symbol: DONSON
  Gene Name: downstream neighbor of SON
  ENSP ID: ENSP00000394276
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKYCIHTSQLLYLTSACKWTKYLIWRLFIRSLLTVVCTLTLWSNLVKYRYLGNHLYGMWC

SEQ ID NO: 25574 - protein, 495 aa, Homo sapiens
  Payload ID: 5072
  Gene Symbol: DONSON
  Gene Name: downstream neighbor of SON
  ENSP ID: ENSP00000398329
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKEVVHKELTNCGLHPNTLEQLSQIPLLGKSSLRNVVLRDYIYNWRS

SEQ ID NO: 25575 - protein, 537 aa, Homo sapiens
  Payload ID: 5072
  Gene Symbol: DONSON
  Gene Name: downstream neighbor of SON
  ENSP ID: ENSP00000399535
  MOD_RES (1)..(1): Any amino acid
XSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKARSVNVKTQALSGYRDQFSLEITGPIMPHSLHSLTMLLKSSQSGSFSAVLYPHEPTAVFNICLQMDKVLDMEVVHKELTNCGLHPNTLEQLSQIPLLGKSSLRNVVLRDYIYNWRS

SEQ ID NO: 25576 - protein, 235 aa, Homo sapiens
  Payload ID: 5072
  Gene Symbol: DONSON
  Gene Name: downstream neighbor of SON
  ENSP ID: ENSP00000401082
  MOD_RES (1)..(1): Any amino acid
XPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKARSVNVKTQALSG

SEQ ID NO: 25577 - protein, 156 aa, Homo sapiens
  Payload ID: 5072
  Gene Symbol: DONSON
  Gene Name: downstream neighbor of SON
  ENSP ID: ENSP00000408788
FLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWY

SEQ ID NO: 25578 - protein, 210 aa, Homo sapiens
  Payload ID: 5072
  Gene Symbol: DONSON
  Gene Name: downstream neighbor of SON
  ENSP ID: ENSP00000415191
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQVCELYFSI

SEQ ID NO: 25579 - protein, 18 aa, Homo sapiens
  Payload ID: 5072
  Gene Symbol: DONSON
  Gene Name: downstream neighbor of SON
  ENSP ID: ENSP00000476496
KSSLRNVVLRDYIYNWRS

SEQ ID NO: 25580 - protein, 489 aa, Homo sapiens
  Payload ID: 5073
  Gene Symbol: DPH2
  Gene Name: DPH2 homolog
  Uniprot ID: Q9BQC3
  ENSP ID: ENSP00000255108
MESMFSSPAEAALQRETGVPGLLTPLPDLDGVYELERVAGFVRDLGCERVALQFPDQLLGDAVAVAARLEETTGSKMFILGDTAYGSCCVDVLGAEQAGAQALIHFGPACLSPPARPLPVAFVLRQRSVALELCVKAFEAQNPDPKAPVVLLSEPACAHALEALATLLRPRYLDLLVSSPAFPQPVGSLSPEPMPLERFGRRFPLAPGRRLEEYGAFYVGGSKASPDPDLDPDLSRLLLGWAPGQPFSSCCPDTGKTQDEGARAGRLRARRRYLVERARDARVVGLLAGTLGVAQHREALAHLRNLTQAAGKRSYVLALGRPTPAKLANFPEVDVFVLLACPLGALAPQLSGSFFQPILAPCELEAACNPAWPPPGLAPHLTHYADLLPGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 25581 - protein, 261 aa, Homo sapiens
  Payload ID: 5073
  Gene Symbol: DPH2
  Gene Name: DPH2 homolog
  Uniprot ID: Q9BQC3
  ENSP ID: ENSP00000379981
MESMFSSPAEAALQRETGVPGLLTPLPDLDGVYELERVAGFVRDLGCERVALQFPDQLLGDAVAVAARLEETTGSKMFILGDTAYGSCCVDVLGAEQAGAQALIHFGPACLSPPARPLPVAFVLRQRSVALELCVKAFEAQNPDPKAPVVLLSEPACAHALGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 25582 - protein, 52 aa, Homo sapiens
  Payload ID: 5073
  Gene Symbol: DPH2
  Gene Name: DPH2 homolog
  ENSP ID: ENSP00000431831
MESMFSSPAEAALQRETGVPGLLTPLPDLDGVYELERVAGFVRDLGCCLAVP

SEQ ID NO: 25583 - protein, 93 aa, Homo sapiens
  Payload ID: 5073
  Gene Symbol: DPH2
  Gene Name: DPH2 homolog
  ENSP ID: ENSP00000431944
MESMFSSPAEAALQRETGVPGLLTPLPDLDGVLPCSSLTSYWEMLWLWLHDWRRRQGQRCSFWVTQPTAAAAWMCWVLSKLELRLSYILALPA

SEQ ID NO: 25584 - protein, 262 aa, Homo sapiens
  Payload ID: 5073
  Gene Symbol: DPH2
  Gene Name: DPH2 homolog
  ENSP ID: ENSP00000432162
AFEAQNPDPKAPVVLLSEPACAHALDTGKTQDEGARAGRLRARRRYLVERARDARVVGLLAGTLGVAQHREALAHLRNLTQAAGKRSYVLALGRPTPAKLANFPEVDVFVLLACPLGALAPQLSGSFFQPILAPCELEAACNPAWPPPGLAPHLTHYADLLPGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 25585 - protein, 100 aa, Homo sapiens
  Payload ID: 5073
  Gene Symbol: DPH2
  Gene Name: DPH2 homolog
  ENSP ID: ENSP00000433273
MESMFSSPAEAALQRETGVPGLLTPLPDLDGVYELERVAGFVRDLGCERVALQFPDQLLGDAVAVAARLEETTGSKMFILGDTAYGSDDSNSPPEENPFL

SEQ ID NO: 25586 - protein, 147 aa, Homo sapiens
  Payload ID: 5073
  Gene Symbol: DPH2
  Gene Name: DPH2 homolog
  ENSP ID: ENSP00000434977
MESMFSSPAEAALQRETGVPGLLTPLPDLDGVYELERVAGFVRDLGCERVALQFPDQLLGDAVAVAARLEETTGSKMFILGDTAYGRGFGYSPAPTVPGPASLQPSFSPTSGFPESRAYAPRAFWAPLPPCPREASRRVWCLLCRGL

SEQ ID NO: 25587 - protein, 35 aa, Homo sapiens
  Payload ID: 5073
  Gene Symbol: DPH2
  Gene Name: DPH2 homolog
  ENSP ID: ENSP00000435561
  MOD_RES (1)..(1): Any amino acid
XSPEPMPLERFGRRFPLAPGRRLEELSLPRGSPTT

SEQ ID NO: 25588 - protein, 102 aa, Homo sapiens
  Payload ID: 5073
  Gene Symbol: DPH2
  Gene Name: DPH2 homolog
  ENSP ID: ENSP00000436330
MESMFSSPAEAALQRETGVPGLLTPLPDLDGVLPCSSLTSYWEMLWLWLHDWRRRQGQRCSFWVTQPTAGVNLALGGPGLGIRGSWGFTSMTVIAFNGGVSP

SEQ ID NO: 25589 - protein, 803 aa, Homo sapiens; identical to SEQ ID NO: 24545
  Payload ID: 5074
  Gene Symbol:
  Gene Name: DPP6
  ENSP ID: ENSP00000488956

SEQ ID NO: 25590 - protein, 291 aa, Homo sapiens; identical to SEQ ID NO: 24550
  Payload ID: 5074
  Gene Symbol:
  Gene Name: DPP6
  ENSP ID: ENSP00000489119

SEQ ID NO: 25591 - protein, 865 aa, Homo sapiens; identical to SEQ ID NO: 24546
  Payload ID: 5074
  Gene Symbol:
  Gene Name: DPP6
  ENSP ID: ENSP00000489137

SEQ ID NO: 25592 - protein, 801 aa, Homo sapiens; identical to SEQ ID NO: 24548
  Payload ID: 5074
  Gene Symbol:
  Gene Name: DPP6
  ENSP ID: ENSP00000489259

SEQ ID NO: 25593 - protein, 353 aa, Homo sapiens; identical to SEQ ID NO: 24547
  Payload ID: 5074
  Gene Symbol:
  Gene Name: DPP6
  ENSP ID: ENSP00000489402

SEQ ID NO: 25594 - protein, 758 aa, Homo sapiens; identical to SEQ ID NO: 24549
  Payload ID: 5074
  Gene Symbol:
  Gene Name: DPP6
  ENSP ID: ENSP00000489584

SEQ ID NO: 25595 - protein, 675 aa, Homo sapiens
  Payload ID: 5075
  Gene Symbol: DPY19L1
  Gene Name: dpy-19-like 1 (C. elegans)
  Uniprot ID: Q2PZI1
  ENSP ID: ENSP00000308695
MEGRPPPEGRPPPRPRTGRAPRGRRRAVFAAVLHWSHITHLFENDRHFSHLSTLEREMAFRTEMGLYYSYFKTIVEAPSFLNGVWMIMNDKLTEYPLVINTLKRFNLYPEVILASWYRIYTKIMDLIGIQTKICWTVTRGEGLSPIESCEGLGDPACFYVAVIFILNGLMMALFFIYGTYLSGSRLGGLVTVLCFFFNHGECTRVMWTPPLRESFSYPFLVLQMLLVTHILRATKLYRGSLIALCISNVFFMLPWQFAQFVLLTQIASLFAVYVVGYIDICKLRKIIYIHMISLALCFVLMFGNSMLLTSYYASSLVIIWGILAMKPHFLKINVSELSLWVIQGCFWLFGTVILKYLTSKIFGIADDAHIGNLLTSKFFSYKDFDTLLYTCAAEFDFMEKETPLRYTKTLLLPVVLVVFVAIVRKIISDMWGVLAKQQTHVRKHQFDHGELVYHALQLLAYTALGILIMRLKLFLTPHMCVMASLICSRQLFGWLFCKVHPGAIVFAILAAMSIQGSANLQTQWNIVGEFSNLPQEELIEWIKYSTKPDAVFAGAMPTMASVKLSALRPIVNHPHYEDAGLRARTKIVYSMYSRKAAEEVKRELIKLKVNYYILEESWCVRRSKPGCSMPEIWDVEDPANAGKTPLCNLLVKDSKPHFTTVFQNSVYKVLEVVKE

SEQ ID NO: 25596 - protein, 206 aa, Homo sapiens
  Payload ID: 5075
  Gene Symbol: DPY19L1
  Gene Name: dpy-19-like 1 (C. elegans)
  ENSP ID: ENSP00000400510
CTRVMWTPPLRESFSYPFLVLQMLLVTHILRATKLYRGSLIALCISNVFFMLPWQFAQFVLLTQIASLFAVYVVGYIDICKLRKIIYIHMGILAMKPHFLKINVSELSLWVIQGCFWLFGTVILKYLTSKIFGIADDAHIGNLLTSKFFSYKDFDTLLYTCAAEFDFMEKETPLRYTKTLLLPVVLVVFVAIVRKIISDMWGVLAK

SEQ ID NO: 25597 - protein, 83 aa, Homo sapiens
  Payload ID: 5075
  Gene Symbol: DPY19L1
  Gene Name: dpy-19-like 1 (C. elegans)
  ENSP ID: ENSP00000412745
  MOD_RES (1)..(1): Any amino acid
XFAGAMPTMASVKLSALRPIVNHPHYEDAGLRPGCSMPEIWDVEDPANAGKTPLCNLLVKDSKPHFTTVFQNSVYKVLEVVKE

SEQ ID NO: 25598 - protein, 85 aa, Homo sapiens
  Payload ID: 5075
  Gene Symbol: DPY19L1
  Gene Name: dpy-19-like 1 (C. elegans)
  Uniprot ID: Q2PZI1
  ENSP ID: ENSP00000478865
MYSRKAAEEVKRELIKLKVNYYILEESWCVRRSKPGCSMPEIWDVEDPANAGKTPLCNLLVKDSKPHFTTVFQNSVYKVLEVVKE

SEQ ID NO: 25599 - protein, 758 aa, Homo sapiens
  Payload ID: 5076
  Gene Symbol: DPY19L2
  Gene Name: dpy-19-like 2 (C. elegans)
  Uniprot ID: Q6NUT2
  ENSP ID: ENSP00000315988
MRKQGVSSKRLQSSGRSQSKGRRGASLAREPEVEEEMEKSALGGGKLPRGSWRSSPGRIQSLKERKGLELEVVAKTFLLGPFQFVRNSLAQLREKVQELQARRFSSRTTLGIAVFVAILHWLHLVTLFENDRHFSHLSSLEREMTFRTEMGLYYSYFKTIIEAPSFLEGLWMIMNDRLTEYPLIINAIKRFHLYPEVIIASWYCTFMGIMNLFGLETKTCWNVTRIEPLNEVQSCEGLGDPACFYVGVIFILNGLMMGLFFMYGAYLSGTQLGGLITVLCFFFNHGEATRVMWTPPLRESFSYPFLVLQMCILTLILRTSSNDRRPFIALCLSNVAFMLPWQFAQFILFTQIASLFPMYVVGYIEPSKFQKIIYMNMISVTLSFILMFGNSMYLSSYYSSSLLMTWAIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISYVLATNIYLRKQLLEHSELAFHTLQLLVFTALAILIMRLKMFLTPHMCVMASLICSRQLFGWLFRRVRFEKVIFGILTVMSIQGYANLRNQWSIIGEFNNLPQEELLQWIKYSTTSDAVFAGAMPTMASIKLSTLHPIVNHPHYEDADLRARTKIVYSTYSRKSAKEVRDKLLELHVNYYVLEEAWCVVRTKPGCSMLEIWDVEDPSNAANPPLCSVLLEDARPYFTTVFQNSVYRVLKVN

SEQ ID NO: 25600 - protein, 149 aa, Homo sapiens
  Payload ID: 5076
  Gene Symbol: DPY19L2
  Gene Name: dpy-19-like 2 (C. elegans)
  ENSP ID: ENSP00000437474
  MOD_RES (1)..(1): Any amino acid
XIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISYVLATNIYLRQMEHREMCLGILKKNEWRTLDTVPIRST

SEQ ID NO: 25601 - protein, 47 aa, Homo sapiens
  Payload ID: 5076
  Gene Symbol: DPY19L2
  Gene Name: dpy-19-like 2 (C. elegans)
  ENSP ID: ENSP00000439567
MTFRTEMGLYYSYFKTIIEAPSFLEGLWMIMNDRLTEYPLIINAIKR

SEQ ID NO: 25602 - protein, 124 aa, Homo sapiens
  Payload ID: 5076
  Gene Symbol: DPY19L2
  Gene Name: dpy-19-like 2 (C. elegans)
  ENSP ID: ENSP00000443126
MFKVFRLFNFIKVGPFQIASLFPMYVVGYIEPSKFQKIIYMNMISVTLSFILMFGNSMYLSSYYSSSLLMTWAIILKRNEIQKLGVSKLNFWLIQGSAWWCGTIILKFLTSKILGVSDHIRLSD

SEQ ID NO: 25603 - protein, 90 aa, Homo sapiens
  Payload ID: 5076
  Gene Symbol: DPY19L2
  Gene Name: dpy-19-like 2 (C. elegans)
  ENSP ID: ENSP00000444932
MRKQGVSSKRLQSSGRSQSKGRRGASLAREPEVEEEMEKSALGGGKLPRGSWRSSPGRIQSLKERKGLELEVVAKTFLLGPFQFVRNSLA

SEQ ID NO: 25604 - protein, 142 aa, Homo sapiens
  Payload ID: 5076
  Gene Symbol: DPY19L2
  Gene Name: dpy-19-like 2 (C. elegans)
  ENSP ID: ENSP00000445878
MRKQGVSSKRLQSSGRSQSKGRRGASLAREPEVEEEMEKSALGGGKLPRGSWRSSPGRIQSLKERKGLELEVVAKTFLLGPFQFVRNSLAQLREKVQELQARRFSSRTTLGIAVFVAILHWDFIIHTSRPLLKHLRFWKDCG

SEQ ID NO: 25605 - protein, 716 aa, Homo sapiens
  Payload ID: 5077
  Gene Symbol: DPY19L3
  Gene Name: dpy-19-like 3 (C. elegans)
  Uniprot ID: Q6ZPD9
  ENSP ID: ENSP00000344937
MMSIRQRREIRATEVSEDFPAQEENVKLENKLPSGCTSRRLWKILSLTIGGTIALCIGLLTSVYLATLHENDLWFSNIKEVEREISFRTECGLYYSYYKQMLQAPTLVQGFHGLIYDNKTESMKTINLLQRMNIYQEVFLSILYRVLPIQKYLEPVYFYIYTLFGLQAIYVTALYITSWLLSGTWLSGLLAAFWYVTNRIDTTRVEFTIPLRENWALPFFAIQIAAITYFLRPNLQPLSERLTLLAIFISTFLFSLTWQFNQFMMLMQALVLFTLDSLDMLPAVKATWLYGIQITSLLLVCILQFFNSMILGSLLISFNLSVFIARKLQKNLKTGSFLNRLGKLLLHLFMVLCLTLFLNNIIKKILNLKSDEHIFKFLKAKFGLGATRDFDANLYLCEEAFGLLPFNTFGRLSDTLLFYAYIFVLSITVIVAFVVAFHNLSDSTNQQSVGKMEKGTVDLKPETAYNLIHTILFGFLALSTMRMKYLWTSHMCVFASFGLCSPEIWELLLKSVHLYNPKRICIMRYSVPILILLYLCYKFWPGMMDELSELREFYDPDTVELMNWINSNTPRKAVFAGSMQLLAGVKLCTGRTLTNHPHYEDSSLRERTRAVYQIYAKRAPEEVHALLRSFGTDYVILEDSICYERRHRRGCRLRDLLDIANGHMMDGPGENDPDLKPADHPRFCEEIKRNLPPYVAYFTRVFQNKTFHVYKLSRNK

SEQ ID NO: 25606 - protein, 716 aa, Homo sapiens; identical to SEQ ID NO: 25605
  Payload ID: 5077
  Gene Symbol: DPY19L3
  Gene Name: dpy-19-like 3 (C. elegans)
  Uniprot ID: Q6ZPD9
  ENSP ID: ENSP00000376081

SEQ ID NO: 25607 - protein, 102 aa, Homo sapiens
  Payload ID: 5077
  Gene Symbol: DPY19L3
  Gene Name: dpy-19-like 3 (C. elegans)
  ENSP ID: ENSP00000465995
MMSIRQRREIRATEVSEDFPAQEENVKLENKLPSGCTSRRLWKILSLTIGGTIALCIGLLTSVYLATLHENDLWFSNIKVWSFFDHCIIHSVGSPVVSHVDE

SEQ ID NO: 25608 - protein, 309 aa, Homo sapiens
  Payload ID: 5077
  Gene Symbol: DPY19L3
  Gene Name: dpy-19-like 3 (C. elegans)
  ENSP ID: ENSP00000465997
  MOD_RES (1)..(1): Any amino acid
XLQPLSERLTLLAIFISTFLFSLTWQFNQFMMLMQALVLFTLDSLDMLPAVKATWLYGIQITSLLLVCILQFFNSMILGSLLISFNLSVFIARKLQKNLKTGSFLNRLGKLLLHLFMVLCLTLFLNNIIKKILNLKSDEHIFKFLKAKFGLGATRDFDANLYLCEEAFGLLPFNTFGRLSDTLLFYAYIFVLSITVIVAFVVAFHNLSDSTNQQSVGKMEKGTVDLKPETAYNLIHTILFGFLALSTMRMKYLWTSHMCVFASFGLCSPEIWELLLKSVHLYNPKRICIMRYSVPILILLYLCYKNQKS

SEQ ID NO: 25609 - protein, 126 aa, Homo sapiens
  Payload ID: 5077
  Gene Symbol: DPY19L3
  Gene Name: dpy-19-like 3 (C. elegans)
  ENSP ID: ENSP00000466062
MMSIRQRREIRATEVSEDFPAQEENVKLENKLPSGCTSRRLWKILSLTIGGTIALCIGLLTSVYLATLHENDLWFSNIKEVEREISFRTECGLYYSYYKQMLQAPTLVQGFHGLIYDNKTESMKTI

SEQ ID NO: 25610 - protein, 688 aa, Homo sapiens
  Payload ID: 5077
  Gene Symbol: DPY19L3
  Gene Name: dpy-19-like 3 (C. elegans)
  ENSP ID: ENSP00000466086
MMSIRQRREIRATEVSEDFPAQEENVKLENKLPSGCTSRRLWKILSLTIGGTIALCIGLLTSVYLATLHENDLWFSNIKEVEREISFRTECGLYYSYYKQMLQAPTLVQGFHGLIYDNKTESMKTINLLQRMNIYQEVFLSILYRVLPIQKYLEPVYFYIYTLFGLQAIYVTALYITSWLLSGTWLSGLLAAFWYVTNRIDTTRVEFTIPLRENWALPFFAIQIAAITYFLRPNLQPLSERLTLLAIFISTFLFSLTWQFNQFMMLMQALVLFTLDSLDMLPAVKATWLYGIQITSLLLVCILQFFNSMILGSLLISFNLSVFIARKLQKNLKTGSFLNRLGKLLLHLFMVLCLTLFLNNIIKKILNLKSDEHIFKFLKAKFGLGATRDFDANLYLCEEAFGLLPFNTFGRLSDTLLFYAYIFVLSITVIVAFVVAFHNLSDSTNQQSVGKMEKGTVDLKPETAYNLIHTILFGFLALSTMRMKYLWTSHMCVFASFGLCSPEIWELLLKSVHLYNPKRICIMRYSVPILILLYLCYKFWPGMMDELSELREFYDPDTVELMNWINSNTPRKAVFAGSMQLLAGVKLCTGRTLTNHPHYEDSSLRERTRAVYQIYAKRAPEEVHALLRSFGTDYVILEDSICYERRHRRGCRLRDLLDIANGHKPSLGTLVTATGAGQGRDDGWPRRE

SEQ ID NO: 25611 - protein, 134 aa, Homo sapiens
  Payload ID: 5077
  Gene Symbol: DPY19L3
  Gene Name: dpy-19-like 3 (C. elegans)
  ENSP ID: ENSP00000474174
  MOD_RES (1)..(1): Any amino acid
XNTFGRLSDTLLFYAYIFVLSITVIVAFVVAFHNLSDSTNQQSVGKMEKGTVDLKPETAYNLIHTILFGFLALSTMRMKYLWTSHMCVFASFGLCSPEIWELLLKSVHLYNPKRICIMRYSVPILILLYLCYKL

SEQ ID NO: 25612 - protein, 723 aa, Homo sapiens
  Payload ID: 5078
  Gene Symbol: DPY19L4
  Gene Name: dpy-19-like 4 (C. elegans)
  Uniprot ID: Q7Z388
  ENSP ID: ENSP00000389630
MAEEEGPPVELRQRKKPKSSENKESAKEEKISDIPIPERAPKHVLFQRFAKIFIGCLAAVTSGMMYALYLSAYHERKFWFSNRQELEREITFQGDSAIYYSYYKDMLKAPSFERGVYELTHNNKTVSLKTINAVQQMSLYPELIASILYQATGSNEIIEPVYFYIGIVFGLQGIYVTALFVTSWLMSGTWLAGMLTVAWFVINRVDTTRIEYSIPLRENWALPYFACQIAALTGYLKSNLNTYGERFCYLLMSASTYTFMMMWEYSHYLLFLQAISLFLLDTFSVEQSDKVYEVYKIYIFSLFLGYLLQFENPALLVSPLLSLVAALMLAKCLQLNVKKGSFVAKIIKVINFYLVCTLTITLNIIMKMFVPHKENGHMLKFLEVKFGLNMTKNFTMNWLLCQESLQAPSQDFFLRLTQSSLLPFYILVLIICFLSMLQVIFRRINGKSLKETVTLEDGRIGERPEIIYHVIHTILLGSLAMVIEGLKYIWIPYVCMLAAFGVCSPELWMTLFKWLRLRTVHPILLALILSMAVPTIIGLSLWKEFFPRLMTELMELQEFYDPDTVELMTWIKRQAPVAAVFAGSPQLMGAIKLCTGWMVTSLPLYNDDDLLKRNENIYQIYSKRSAEDIYKILTSYKANYLIVEDAICNEVGPMRGCRVKDLLDIANGHMVCEEGDKLTYSKYGRFCHEVKINYSPYVNYFTRVYWNRSYFVYKINTVISFQS

SEQ ID NO: 25613 - protein, 114 aa, Homo sapiens
  Payload ID: 5078
  Gene Symbol: DPY19L4
  Gene Name: dpy-19-like 4 (C. elegans)
  ENSP ID: ENSP00000428041
  MOD_RES (1)..(1): Any amino acid
XKRKSVTFQFLKELQNELEREITFQGDSAIYYSYYKDMLKAPSFERGVYELTHNNKTVSLKTINAVQQMSLYPELIASILYQATGSNEIIEPVYFYIGIVFGLQGIYVTALFVT

SEQ ID NO: 25614 - protein, 128 aa, Homo sapiens
  Payload ID: 5078
  Gene Symbol: DPY19L4
  Gene Name: dpy-19-like 4 (C. elegans)
  ENSP ID: ENSP00000428762
MAEEEGPPVELRQRKKPKSSENKESAKEEKISDIPIPERAPKRVYELTHNNKTVSLKTINAVQQMSLYPELIASILYQATGSNEIIEPVYFYIGIVFGLQGIYVTALFVTSWLMSGTWLAGMLTVAWF

SEQ ID NO: 25615 - protein, 67 aa, Homo sapiens
  Payload ID: 5078
  Gene Symbol: DPY19L4
  Gene Name: dpy-19-like 4 (C. elegans)
  ENSP ID: ENSP00000429559
ATGSNEIIEPVYFYIGIVFGLQGIYVTALFVTSWLMSGTWLAGMLTVAWFVINRAACNLAAGLPYSE

SEQ ID NO: 25616 - protein, 75 aa, Homo sapiens
  Payload ID: 5078
  Gene Symbol: DPY19L4
  Gene Name: dpy-19-like 4 (C. elegans)
  ENSP ID: ENSP00000429711
  MOD_RES (1)..(1): Any amino acid
XWIPYVCMLAAFGVCSPELWMTLFKWLRLRTVHPILLALILSMAVPTIIGLSLWKEKASSSCSCVCRESTVNGCD

SEQ ID NO: 25617 - protein, 276 aa, Homo sapiens
  Payload ID: 5078
  Gene Symbol: DPY19L4
  Gene Name: dpy-19-like 4 (C. elegans)
  ENSP ID: ENSP00000429785
  MOD_RES (1)..(1): Any amino acid
XIEPVYFYIGIVFGLQGIYVTALFVTSWLMSGTWLAGMLTVAWFVINRVDTTRIEYSIPLRENWALPYFACQIAALTGYLKSNLNTYGERFCYLLMSASTYTFMMMWEYSHYLLFLQAISLFLLDTFSVEQSDKLNVKKGSFVAKIIKVINFYLVCTLTITLNIIMKMFVPHKENGHMLKFLEVKFGLNMTKNFTMNWLLCQESLQAPSQDFFLRLTQSSLLPFYILVLIICFLSMLQVIFRRINGKSLKETVTLEDGRIGERPEIIYHVIHTILL

SEQ ID NO: 25618 - protein, 44 aa, Homo sapiens
  Payload ID: 5078
  Gene Symbol: DPY19L4
  Gene Name: dpy-19-like 4 (C. elegans)
  ENSP ID: ENSP00000430162
MAEEEGPPVELRQRKKPKSSENKESAKEEKISDIPIPERAPKRA

SEQ ID NO: 25619 - protein, 190 aa, Homo sapiens
  Payload ID: 5078
  Gene Symbol: DPY19L4
  Gene Name: dpy-19-like 4 (C. elegans)
  ENSP ID: ENSP00000430417
KISDIPIPERAPKHVLFQRFAKIFIGCLAAVTSGMMYALYLSAYHERKFWFSNRQELEREITFQGDSAIYYSYYKDMLKAPSFERGVYELTHNNKTVSLKTINAVQQMSLYPELIASILYQATGSNEIIEPVYFYIGIVFGLQGIYVTALFVTSWLMSGTWLAGMLTVAWFVINSCTDPWYSVGGDNTGY

SEQ ID NO: 25620 - protein, 177 aa, Homo sapiens
  Payload ID: 5079
  Gene Symbol: DYDC1
  Gene Name: DPY30 domain containing 1
  Uniprot ID: Q8WWB3
  ENSP ID: ENSP00000361276
MESIYLQKHLGACLTQGLAEVARVRPVDPIEYLALWIYKYKENVTMEQLRQKEMAKLERERELALMEQEMMERLKAEELLLQQQQLALQLELEMQEKERQRIQELQRAQEQLGKEMRMNMENLVRNEDILHSEEATLDSGKTLAEISDRYGAPNLSRVEELDEPMFSDIALNIDQDL

SEQ ID NO: 25621 - protein, 177 aa, Homo sapiens; identical to SEQ ID NO: 25620
  Payload ID: 5079
  Gene Symbol: DYDC1
  Gene Name: DPY30 domain containing 1
  Uniprot ID: Q8WWB3
  ENSP ID: ENSP00000361278

SEQ ID NO: 25622 - protein, 80 aa, Homo sapiens
  Payload ID: 5079
  Gene Symbol: DYDC1
  Gene Name: DPY30 domain containing 1
  ENSP ID: ENSP00000388160
MESIYLQKHLGACLTQGLAEVARVRPVDPIEYLALWIYKYKENVTMEQLRQKEMAKLERERELALMEQEMMERLKAEELL

SEQ ID NO: 25623 - protein, 177 aa, Homo sapiens; identical to SEQ ID NO: 25620
  Payload ID: 5079
  Gene Symbol: DYDC1
  Gene Name: DPY30 domain containing 1
  Uniprot ID: Q8WWB3
  ENSP ID: ENSP00000402890

SEQ ID NO: 25624 - protein, 152 aa, Homo sapiens
  Payload ID: 5079
  Gene Symbol: DYDC1
  Gene Name: DPY30 domain containing 1
  ENSP ID: ENSP00000414798
MESIYLQKHLGACLTQGLAEVARVRPVDPIEYLALWIYKYKENVTMEQLRQKEMAKLERERELALMEQEMMERLKAEELLLQQQQLALQLELEMQEKERQRIQELQRAQEQLGKEMRMNMENLVRNEDILHSEEATLDSGKTLAEISDRYGA

SEQ ID NO: 25625 - protein, 177 aa, Homo sapiens
  Payload ID: 5080
  Gene Symbol: DYDC2
  Gene Name: DPY30 domain containing 2
  Uniprot ID: Q96IM9
  ENSP ID: ENSP00000256039
METNYLKRCFGNCLAQALAEVAKVRPSDPIEYLAHWLYHYRKTAKAKEENREKKIHLQEEYDSSLKEMEMTEMLKQEEYQIQQNCEKCHKELTSETVSTKKTIFMQEDTNPLEKEALKQEFLPGTSSLIPGMPQQVPPSESAGQIDQNFKMPQEINYKEAFQHEVAHEMPPGSKSPF

SEQ ID NO: 25626 - protein, 177 aa, Homo sapiens; identical to SEQ ID NO: 25625
  Payload ID: 5080
  Gene Symbol: DYDC2
  Gene Name: DPY30 domain containing 2
  Uniprot ID: Q96IM9
  ENSP ID: ENSP00000361271

SEQ ID NO: 25627 - protein, 191 aa, Homo sapiens
  Payload ID: 5080
  Gene Symbol: DYDC2
  Gene Name: DPY30 domain containing 2
  ENSP ID: ENSP00000361272
MILRPPQQCGTAARMETNYLKRCFGNCLAQALAEVAKVRPSDPIEYLAHWLYHYRKTAKAKEENREKKIHLQEEYDSSLKEMEMTEMLKQEEYQIQQNCEKCHKELTSETVSTKKTIFMQEDTNPLEKEALKQEFLPGTSSLIPGMPQQVPPSESAGQIDQNFKMPQEINYKEAFQHEVAHEMPPGSKSPF

SEQ ID NO: 25628 - protein, 177 aa, Homo sapiens; identical to SEQ ID NO: 25625
  Payload ID: 5080
  Gene Symbol: DYDC2
  Gene Name: DPY30 domain containing 2
  Uniprot ID: Q96IM9
  ENSP ID: ENSP00000361273

SEQ ID NO: 25629 - protein, 125 aa, Homo sapiens
  Payload ID: 5080
  Gene Symbol: DYDC2
  Gene Name: DPY30 domain containing 2
  ENSP ID: ENSP00000401333
METNYLKRCFGNCLAQALAEVAKVRPSDPIEYLAHWLYHYRKTAKAKEENREKKIHLQEEYDSSLKEMEMTEMLKQEEYQIQQNCEKCHKELTSETVSTKKTIFMQEDTNPLEKEALKQEFLPGT

SEQ ID NO: 25630 - protein, 177 aa, Homo sapiens; identical to SEQ ID NO: 25625
  Payload ID: 5080
  Gene Symbol: DYDC2
  Gene Name: DPY30 domain containing 2
  Uniprot ID: Q96IM9
  ENSP ID: ENSP00000410285

SEQ ID NO: 25631 - protein, 177 aa, Homo sapiens; identical to SEQ ID NO: 25625
  Payload ID: 5080
  Gene Symbol: DYDC2
  Gene Name: DPY30 domain containing 2
  Uniprot ID: Q96IM9
  ENSP ID: ENSP00000483479

SEQ ID NO: 25632 - protein, 99 aa, Homo sapiens
  Payload ID: 5081
  Gene Symbol: DPY30
  Gene Name: dpy-30 histone methyltransferase complex regulatory subunit
  Uniprot ID: Q9C005
  ENSP ID: ENSP00000295066
MEPEQMLEGQTQVAENPHSEYGLTDNVERIVENEKINAEKSSKQKVDLQSLPTRAYLDQTVVPILLQGLAVLAKERPPNPIEFLASYLLKNKAQFEDRN

SEQ ID NO: 25633 - protein, 99 aa, Homo sapiens; identical to SEQ ID NO: 25632
  Payload ID: 5081
  Gene Symbol: DPY30
  Gene Name: dpy-30 histone methyltransferase complex regulatory subunit
  Uniprot ID: Q9C005
  ENSP ID: ENSP00000345837

SEQ ID NO: 25634 - protein, 205 aa, Homo sapiens
  Payload ID: 5082
  Gene Symbol: DRAP1
  Gene Name: DR1-associated protein 1 (negative cofactor 2 alpha)
  Uniprot ID: Q14919
  ENSP ID: ENSP00000307850
MPSKKKKYNARFPPARIKKIMQTDEEIGKVAAAVPVIISRALELFLESLLKKACQVTQSRNAKTMTTSHLKQCIELEQQFDFLKDLVASVPDMQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 25635 - protein, 212 aa, Homo sapiens
  Payload ID: 5082
  Gene Symbol: DRAP1
  Gene Name: DR1-associated protein 1 (negative cofactor 2 alpha)
  ENSP ID: ENSP00000366190
MPSKKKKYNARFPPARIKKIMQTDEEIGKVAAAVPVIISRALELFLESLLKKACQVTQSRNAKTMTTSHLKQCIELEQQFDFLKDLVASVPDMQGDGEDNHMDGDKGARRWTVPSQRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 25636 - protein, 185 aa, Homo sapiens
  Payload ID: 5082
  Gene Symbol: DRAP1
  Gene Name: DR1-associated protein 1 (negative cofactor 2 alpha)
  ENSP ID: ENSP00000432445
MQTDEEIGKVAAAVPVIISRALELFLESLLKKACQVTQSRNAKTMTTSHLKQCIELEQQFDFLKDLVASVPDMQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 25637 - protein, 155 aa, Homo sapiens
  Payload ID: 5082
  Gene Symbol: DRAP1
  Gene Name: DR1-associated protein 1 (negative cofactor 2 alpha)
  ENSP ID: ENSP00000437225
MPSKKKKYNARFPPARIKKIMQTDEEIGKVAAAVPVIISRALELFLESLLKKACQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSA

SEQ ID NO: 25638 - protein, 161 aa, Homo sapiens
  Payload ID: 5082
  Gene Symbol: DRAP1
  Gene Name: DR1-associated protein 1 (negative cofactor 2 alpha)
  ENSP ID: ENSP00000437287
MPSKKKKYNARFPPSRNAKTMTTSHLKQCIELEQQFDFLKDLVASVPDMQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 25639 - protein, 651 aa, Homo sapiens
  Payload ID: 5083
  Gene Symbol: DBN1
  Gene Name: drebrin 1
  Uniprot ID: Q16643
  ENSP ID: ENSP00000292385
MAGHPWHGTAALASSQAWRDGRERQALVSCRALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEIHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGESLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 25640 - protein, 649 aa, Homo sapiens
  Payload ID: 5083
  Gene Symbol: DBN1
  Gene Name: drebrin 1
  Uniprot ID: Q16643
  ENSP ID: ENSP00000308532
MAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEIHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGESLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 25641 - protein, 695 aa, Homo sapiens
  Payload ID: 5083
  Gene Symbol: DBN1
  Gene Name: drebrin 1
  Uniprot ID: Q16643
  ENSP ID: ENSP00000377195
MAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRPGRPYCPFIKASDSGPSSSSSSSSSPPRTPFPYITCHRTPNLSSSLPCSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEIHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGESLAAPQTPTLPSALEELEQEQEPEPHLLTNGETTQKEGTQASEGYFSQSQEEEFAQSEELCAKAPPPVFYNKPPEIDITCWDADPVPEEEEGFEGGD

SEQ ID NO: 25642 - protein, 124 aa, Homo sapiens
  Payload ID: 5083
  Gene Symbol: DBN1
  Gene Name: drebrin 1
  ENSP ID: ENSP00000421465
MAGVSFSGHRLELLAAYEEVIREESAADWALYTYEDGSDDLKLAASGEGGLQELSGHFENQKVMYGFCSVKDSQAALPKYVLINWVGEDVPDARKCACASHVAKVAEFFQGVDVIVNASSVEDI

SEQ ID NO: 25643 - protein, 317 aa, Homo sapiens
  Payload ID: 5083
  Gene Symbol: DBN1
  Gene Name: drebrin 1
  ENSP ID: ENSP00000422854
MAGVSFSGHRLELLAAYEEVIREESAADWALYTYEDGSDDLKLAASGGGLQELSGHFENQKVMYGFCSVKDSQAALPKYVLINWVGEDVPDARKCACASHVAKVAEFFQGVDVIVNASSVEDIDAGAIGQRLSNGLARLSSPVLHRLRLREDENAEPVGTTYQKTDAAVEMKRINREQFWEQAKKEEELRKEEERKKALDERLRFEQERMEQERQEQEERERRYREREQQIEEHRRKQQTLEAEEAKRRLKEQSIFGDHRDEEEETHMKKSESEVEEAAAIIAQRPDNPREFFKQQERVASASAGSCDVPSPFNHRP

SEQ ID NO: 25644 - protein, 391 aa, Homo sapiens
  Payload ID: 5083
  Gene Symbol: DBN1
  Gene Name: drebrin 1
  ENSP ID: ENSP00000423208
MKKSESEVEEAAAIIAQRPDNPREFFKQQERVASASAGSCDVPSPFNHRPGSHLDSHRRMAPTPIPTRSPSDSSTASTPVAEQIERALDEVTSSQPPPLPPPPPPAQETQEPSPILDSEETRAAAPQAWAGPMEEPPQAQAPPRGPGSPAEDLMFMESAEQAVLAAPVEPATADATEIHDAADTIETDTATADTTVANNVPPAATSLIDLWPGNGEGASTLQGEPRAPTPPSGTEVTLAEVPLLDEVAPEPLLPAGEGCATLLNFDELPEPPATFCDPEEVEGESLAAPQTPTLPSALEELEQEQEPEPHLLTNGETTQKEGTQVRQGLPGGRDGREWGLSRVLALHSSCLHQYPLLCDPHYLRGSPSHPPSLGRLCFCSQGRHPCFPGNH

SEQ ID NO: 25645 - protein, 93 aa, Homo sapiens
  Payload ID: 5083
  Gene Symbol: DBN1
  Gene Name: drebrin 1
  ENSP ID: ENSP00000425546
MYGFCSVKDSQAALPKYVLINWVGEDVPDARKCACASHVAKVAEFFQGVDVIVNASSVEDIDAGAIGQRLSNGLARLSSPVLHRLRLREDENA

SEQ ID NO: 25646 - protein, 62 aa, Homo sapiens
  Payload ID: 5084
  Gene Symbol: DBNL
  Gene Name: drebrin-like
  ENSP ID: ENSP00000390397
MAANLSRNGPALQEAYVRVVTEKSPTDWALFTYEGNSNDIRVAGTGGGPCDHQRTGRGGCGA

SEQ ID NO: 25647 - protein, 50 aa, Homo sapiens
  Payload ID: 5084
  Gene Symbol: DBNL
  Gene Name: drebrin-like
  ENSP ID: ENSP00000392113
MAANLSRNGPALQEAYVRVVTEKSPTDWALFTYEGNSNDIRCCSCCRGPM

SEQ ID NO: 25648 - protein, 138 aa, Homo sapiens
  Payload ID: 5084
  Gene Symbol: DBNL
  Gene Name: drebrin-like
  ENSP ID: ENSP00000397855
  MOD_RES (1)..(1): Any amino acid
XKQKERAMSTTSISSPQPDLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 25649 - protein, 359 aa, Homo sapiens
  Payload ID: 5084
  Gene Symbol: DBNL
  Gene Name: drebrin-like
  ENSP ID: ENSP00000398931
  MOD_RES (1)..(1): Any amino acid
XATAMTSAWLAQGTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 25650 - protein, 87 aa, Homo sapiens
  Payload ID: 5084
  Gene Symbol: DBNL
  Gene Name: drebrin-like
  ENSP ID: ENSP00000400817
MAANLSRNGPALQEAYVRVVTEKSPTDWALFTYEGNSNDIRVAGTGDRRGRERCAEGSLCQPRQHHGQLPEGGPCDHQRTGRGGCGA

SEQ ID NO: 25651 - protein, 27 aa, Homo sapiens
  Payload ID: 5084
  Gene Symbol: DBNL
  Gene Name: drebrin-like
  ENSP ID: ENSP00000403372
MAANLSRNGPALQEAYVRVVTEKSPTD

SEQ ID NO: 25652 - protein, 406 aa, Homo sapiens
  Payload ID: 5084
  Gene Symbol: DBNL
  Gene Name: drebrin-like
  ENSP ID: ENSP00000405343
MAANLSRNGPALQEAYVRVVTEKSPTDWALFTYEGNSNDIRVAGTGEGGLEEMVEELNSGKVMYAFCRVKDPNSGLPKFVLINWGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 25653 - protein, 31 aa, Homo sapiens
  Payload ID: 5084
  Gene Symbol: DBNL
  Gene Name: drebrin-like
  ENSP ID: ENSP00000410681
MAANLSRNGPALQEAYVRVVTEKSPTDWGPM

SEQ ID NO: 25654 - protein, 430 aa, Homo sapiens
  Payload ID: 5084
  Gene Symbol: DBNL
  Gene Name: drebrin-like
  Uniprot ID: Q9UJU6
  ENSP ID: ENSP00000411701
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 25655 - protein, 327 aa, Homo sapiens
  Payload ID: 5084
  Gene Symbol: DBNL
  Gene Name: drebrin-like
  Uniprot ID: Q9UJU6
  ENSP ID: ENSP00000415173
MASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 25656 - protein, 48 aa, Homo sapiens
  Payload ID: 5084
  Gene Symbol: DBNL
  Gene Name: drebrin-like
  ENSP ID: ENSP00000415395
MAANLSRNGPALQEAYVRVVTEKSPTDWWAARRARVGPGAASGGSLYL

SEQ ID NO: 25657 - protein, 382 aa, Homo sapiens
  Payload ID: 5084
  Gene Symbol: DBNL
  Gene Name: drebrin-like
  Uniprot ID: Q9UJU6
  ENSP ID: ENSP00000416421
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 25658 - protein, 439 aa, Homo sapiens
  Payload ID: 5084
  Gene Symbol: DBNL
  Gene Name: drebrin-like
  Uniprot ID: Q9UJU6
  ENSP ID: ENSP00000417653
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQGSTCASLQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 25659 - protein, 336 aa, Homo sapiens
  Payload ID: 5084
  Gene Symbol: DBNL
  Gene Name: drebrin-like
  Uniprot ID: Q9UJU6
  ENSP ID: ENSP00000417749
MKATAMTSAWLAQGGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 25660 - protein, 128 aa, Homo sapiens
  Payload ID: 5084
  Gene Symbol: DBNL
  Gene Name: drebrin-like
  ENSP ID: ENSP00000418006
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKVRPGGPCDHQRTGRGGCGA

SEQ ID NO: 25661 - protein, 40 aa, Homo sapiens
  Payload ID: 5084
  Gene Symbol: DBNL
  Gene Name: drebrin-like
  ENSP ID: ENSP00000418301
MAANLSRNGPALQEAYVRVVTEKSPTDWWAARRARGSLYL

SEQ ID NO: 25662 - protein, 48 aa, Homo sapiens; identical to SEQ ID NO: 25656
  Payload ID: 5084
  Gene Symbol: DBNL
  Gene Name: drebrin-like
  ENSP ID: ENSP00000418978

SEQ ID NO: 25663 - protein, 431 aa, Homo sapiens
  Payload ID: 5084
  Gene Symbol: DBNL
  Gene Name: drebrin-like
  Uniprot ID: Q9UJU6
  ENSP ID: ENSP00000419992
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQSRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 25664 - protein, 1374 aa, Homo sapiens
  Payload ID: 5085
  Gene Symbol: DROSHA
  Gene Name: drosha, ribonuclease type III
  Uniprot ID: Q9NRR4
  ENSP ID: ENSP00000339845
MMQGNTCHRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSRERERERHRHRDNRRSPSLERSYKKEYKRSGRSYGLSVVPEPAGCTPELPGEIIKNTDSWAPPLEIVNHRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 25665 - protein, 1337 aa, Homo sapiens
  Payload ID: 5085
  Gene Symbol: DROSHA
  Gene Name: drosha, ribonuclease type III
  Uniprot ID: Q9NRR4
  ENSP ID: ENSP00000409335
MMQGNTCHRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSRERERERHRHRDNRRSPSLERSYKKEYKRSGSRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 25666 - protein, 375 aa, Homo sapiens
  Payload ID: 5085
  Gene Symbol: DROSHA
  Gene Name: drosha, ribonuclease type III
  ENSP ID: ENSP00000422745
  MOD_RES (1)..(1): Any amino acid
XYSHHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSSRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLT

SEQ ID NO: 25667 - protein, 1337 aa, Homo sapiens; identical to SEQ ID NO: 25665
  Payload ID: 5085
  Gene Symbol: DROSHA
  Gene Name: drosha, ribonuclease type III
  Uniprot ID: Q9NRR4
  ENSP ID: ENSP00000424161

SEQ ID NO: 25668 - protein, 1374 aa, Homo sapiens; identical to SEQ ID NO: 25664
  Payload ID: 5085
  Gene Symbol: DROSHA
  Gene Name: drosha, ribonuclease type III
  Uniprot ID: Q9NRR4
  ENSP ID: ENSP00000425979

SEQ ID NO: 25669 - protein, 195 aa, Homo sapiens
  Payload ID: 5085
  Gene Symbol: DROSHA
  Gene Name: drosha, ribonuclease type III
  ENSP ID: ENSP00000428782
HFRHLPPYPLPKAPSERRSPERLKHYDDHRHRDHSHGRGERHRSLDRRERGRSPDRRRQDSRYRSDYDRGRTPSRHRSYERSRSYGLSVVPEPAGCTPELPGEIIKNTDSWAPPLEIVNHRSPSREKKRARWEEEKDRWSDNQSSGKDKNYTSIKEKEPEETMPDKNEEEEEELLKPVWIRCTHSENYYSSDPMD

SEQ ID NO: 25670 - protein, 201 aa, Homo sapiens
  Payload ID: 5085
  Gene Symbol: DROSHA
  Gene Name: drosha, ribonuclease type III
  ENSP ID: ENSP00000430921
MMQGNTCHRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSS

SEQ ID NO: 25671 - protein, 249 aa, Homo sapiens
  Payload ID: 5086
  Gene Symbol: DSN1
  Gene Name: DSN1 homolog, MIS12 kinetochore complex component
  Uniprot ID: Q9H410
  ENSP ID: ENSP00000362839
MTSVTRSEIIDELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 25672 - protein, 284 aa, Homo sapiens
  Payload ID: 5086
  Gene Symbol: DSN1
  Gene Name: DSN1 homolog, MIS12 kinetochore complex component
  ENSP ID: ENSP00000362845
MTSVTRSEIIDEQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 25673 - protein, 356 aa, Homo sapiens
  Payload ID: 5086
  Gene Symbol: DSN1
  Gene Name: DSN1 homolog, MIS12 kinetochore complex component
  Uniprot ID: Q9H410
  ENSP ID: ENSP00000362855
MTSVTRSEIIDEKGPVMSKTHDHQLESSLSPVEVFAKTSASLEMNQGVSEERIHLGSSPKKGGNCDLSHQERLQSKSLHLSPQEQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 25674 - protein, 356 aa, Homo sapiens; identical to SEQ ID NO: 25673
  Payload ID: 5086
  Gene Symbol: DSN1
  Gene Name: DSN1 homolog, MIS12 kinetochore complex component
  Uniprot ID: Q9H410
  ENSP ID: ENSP00000389810

SEQ ID NO: 25675 - protein, 141 aa, Homo sapiens
  Payload ID: 5086
  Gene Symbol: DSN1
  Gene Name: DSN1 homolog, MIS12 kinetochore complex component
  ENSP ID: ENSP00000395760
MKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILS

SEQ ID NO: 25676 - protein, 241 aa, Homo sapiens
  Payload ID: 5086
  Gene Symbol: DSN1
  Gene Name: DSN1 homolog, MIS12 kinetochore complex component
  ENSP ID: ENSP00000399654
MTSVTRSEIIDEKGPVMSKTHDHQLESSLSPVEVFAKTSASLEMNQGVSEERIHLGSSPKKGGNCDLSHQERLQSKSLHLSPQEQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILS

SEQ ID NO: 25677 - protein, 340 aa, Homo sapiens
  Payload ID: 5086
  Gene Symbol: DSN1
  Gene Name: DSN1 homolog, MIS12 kinetochore complex component
  Uniprot ID: Q9H410
  ENSP ID: ENSP00000404463
MSKTHDHQLESSLSPVEVFAKTSASLEMNQGVSEERIHLGSSPKKGGNCDLSHQERLQSKSLHLSPQEQSASYQDRRQSWRRASMKETNRRKSLHPIHQGITELSRSISVDLAESKRLGCLLLSSFQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 25678 - protein, 304 aa, Homo sapiens
  Payload ID: 5087
  Gene Symbol: DTWD1
  Gene Name: DTW domain containing 1
  Uniprot ID: Q8N5C7
  ENSP ID: ENSP00000251250
MSLNPPIFLKRSEENSSKFVETKQSQTTSIASEDPLQNLCLASQEVLQKAQQSGRSKCLKCGGSRMFYCYTCYVPVENVPIEQIPLVKLPLKIDIIKHPNETDGKSTAIHAKLLAPEFVNIYTYPCIPEYEEKDHEVALIFPGPQSISIKDISFHLQKRIQNNVRGKNDDPDKPSFKRKRTEEQEFCDLNDSKCKGTTLKKIIFIDSTWNQTNKIFTDERLQGLLQVELKTRKTCFWRHQKGKPDTFLSTIEAIYYFLVDYHTDILKEKYRGQYDNLLFFYSFMYQLIKNAKCSGDKETGKLTH

SEQ ID NO: 25679 - protein, 304 aa, Homo sapiens; identical to SEQ ID NO: 25678
  Payload ID: 5087
  Gene Symbol: DTWD1
  Gene Name: DTW domain containing 1
  Uniprot ID: Q8N5C7
  ENSP ID: ENSP00000385399

SEQ ID NO: 25680 - protein, 109 aa, Homo sapiens
  Payload ID: 5087
  Gene Symbol: DTWD1
  Gene Name: DTW domain containing 1
  Uniprot ID: Q8N5C7
  ENSP ID: ENSP00000452628
MSLNPPIFLKRSEENSSKFVETKQSQTTSIASEDPLQNLCLASQEVLQKAQQSGRSKCLKCGGSRMFYCYTCYVPVENVPIEQIPLVKFSLYHLGQSMVSSASKITCIG

SEQ ID NO: 25681 - protein, 94 aa, Homo sapiens
  Payload ID: 5087
  Gene Symbol: DTWD1
  Gene Name: DTW domain containing 1
  ENSP ID: ENSP00000452685
MSLNPPIFLKRSEENSSKFVETKQSQTTSIASEDPLQNLCLASQEVLQKAQQSGRSKCLKCGGSRMFYCYTCYVPVENVPIEQIPLVKLPLKID

SEQ ID NO: 25682 - protein, 193 aa, Homo sapiens
  Payload ID: 5087
  Gene Symbol: DTWD1
  Gene Name: DTW domain containing 1
  ENSP ID: ENSP00000453071
MSLNPPIFLKRSEENSSKFVETKQSQTTSIASEDPLQNLCLASQEVLQKAQQSGRSKCLKCGGSRMFYCYTCYVPVENVPIEQIPLVKLPLKIDIIKHPNETDGKSTAIHAKLLAPEFVNIYTYPCIPEYEEKDHERQVSLCCPDWSRTPRAQVILSPWPPKVPGLQVALIFPGPQSISIKDISFHLQKRIQN

SEQ ID NO: 25683 - protein, 304 aa, Homo sapiens; identical to SEQ ID NO: 25678
  Payload ID: 5087
  Gene Symbol: DTWD1
  Gene Name: DTW domain containing 1
  Uniprot ID: Q8N5C7
  ENSP ID: ENSP00000453529

SEQ ID NO: 25684 - protein, 152 aa, Homo sapiens
  Payload ID: 5087
  Gene Symbol: DTWD1
  Gene Name: DTW domain containing 1
  ENSP ID: ENSP00000453649
MSLNPPIFLKRSEENSSKFVETKQSQTTSIASEDPLQNLCLASQEVLQKAQQSGRSKCLKCGGSRMFYCYTCYVPVENVPIEQIPLVKIDIIKHPNETDGKSTAIHAKLLAPEFVNIYTYPCIPEYEEKDHEVALIFPGPQSISIKDISFHL

SEQ ID NO: 25685 - protein, 102 aa, Homo sapiens
  Payload ID: 5087
  Gene Symbol: DTWD1
  Gene Name: DTW domain containing 1
  ENSP ID: ENSP00000453686
MSLNPPIFLKRSEENSSKFVETKQSQTTSIASEDPLQNLCLASQEVLQKAQQSGRSKCLKCGGSRMFYCYTCYVPVENVPIEQIPLVKENPMPEDLSLSPMS

SEQ ID NO: 25686 - protein, 232 aa, Homo sapiens
  Payload ID: 5088
  Gene Symbol: DTWD2
  Gene Name: DTW domain containing 2
  ENSP ID: ENSP00000302892
MPGTATYRPQKVCLCPFLPAHPLHISTHLYIIQHPAEENKVLRTVPLLAACLPQDKCKVKIGRRFSEERDPELSTVCRKSGTLILYPGAEAANLEEFILDSPVYPSTIIIIDGTWSQAKDIFYKNSLFRHPKQVQLKTSISSQYVIRMQPTNRCLSTLECAAVALSILEKNNYIQETLLRPLQALCSFQLQHGAQIRLSKEHLLKNGLYPKPMPKNKRKLRKMELLMNSVKI

SEQ ID NO: 25687 - protein, 202 aa, Homo sapiens
  Payload ID: 5088
  Gene Symbol: DTWD2
  Gene Name: DTW domain containing 2
  ENSP ID: ENSP00000424221
MESQKEARTLQEPVARPSGASSSQTPNDKERREGGAVPAAAALGAEADDDSADGLWELPVEPAERRPECTRCSRPQKVCLCPFLPAHPLHISTHLYIIQHPAEVQLKTSISSQYVIRMQPTNRCLSTLECAAVALSILEKNNYIQETLLRPLQALCSFQLQHGAQIRLSKEHLLKNGLYPKPMPKNKRKLRKMELLMNSVKI

SEQ ID NO: 25688 - protein, 137 aa, Homo sapiens
  Payload ID: 5088
  Gene Symbol: DTWD2
  Gene Name: DTW domain containing 2
  ENSP ID: ENSP00000425016
MESQKEARTLQEPVARPSGASSSQTPNDKERREGGAVPAAAALGAEADDDSADGLWELPVEPAERRPECTRCSRPQKVCLCPFLPAHPLHISTHLYIIQHPAEENKVLRTVPLLAACLPQDKCKVKIGRRFSEERCN

SEQ ID NO: 25689 - protein, 298 aa, Homo sapiens
  Payload ID: 5088
  Gene Symbol: DTWD2
  Gene Name: DTW domain containing 2
  Uniprot ID: Q8NBA8
  ENSP ID: ENSP00000425048
MESQKEARTLQEPVARPSGASSSQTPNDKERREGGAVPAAAALGAEADDDSADGLWELPVEPAERRPECTRCSRPQKVCLCPFLPAHPLHISTHLYIIQHPAEENKVLRTVPLLAACLPQDKCKVKIGRRFSEERDPELSTVCRKSGTLILYPGAEAANLEEFILDSPVYPSTIIIIDGTWSQAKDIFYKNSLFRHPKQVQLKTSISSQYVIRMQPTNRCLSTLECAAVALSILEKNNYIQETLLRPLQALCSFQLQHGAQIRLSKEHLLKNGLYPKPMPKNKRKLRKMELLMNSVKI

SEQ ID NO: 25690 - protein, 209 aa, Homo sapiens
  Payload ID: 5089
  Gene Symbol: DTD1
  Gene Name: D-tyrosyl-tRNA deacylase 1
  Uniprot ID: Q8TEA8
  ENSP ID: ENSP00000366672
MKAVVQRVTRASVTVGGEQISAIGRGICVLLGISLEDTQKELEHMVRKILNLRVFEDESGKHWSKSVMDKQYEILCVSQFTLQCVLKGNKPDFHLAMPTEQAEGFYNSFLEQLRKTYRPELIKDGKFGAYMQVHIQNDGPVTIELESPAPGTATSDPKQLSKLEKQQQRKEKTRAKGPSESSKERNTPRKEDRSASSGAEGDVSSEREP

SEQ ID NO: 25691 - protein, 223 aa, Homo sapiens
  Payload ID: 5089
  Gene Symbol: DTD1
  Gene Name: D-tyrosyl-tRNA deacylase 1
  ENSP ID: ENSP00000482916
MYRNEFTAWYRRMSVVYGIGTWSVLGSLLYYSRTMAKSSVGGEQISAIGRGICVLLGISLEDTQKELEHMVRKILNLRVFEDESGKHWSKSVMDKQYEILCVSQFTLQCVLKGNKPDFHLAMPTEQAEGFYNSFLEQLRKTYRPELIKDGKFGAYMQVHIQNDGPVTIELESPAPGTATSDPKQLSKLEKQQQRKEKTRAKGPSESSKERNTPRKEDRSASSG

SEQ ID NO: 25692 - protein, 168 aa, Homo sapiens
  Payload ID: 5090
  Gene Symbol: DTD2
  Gene Name: D-tyrosyl-tRNA deacylase 2 (putative)
  Uniprot ID: Q96FN9
  ENSP ID: ENSP00000312224
MAEGSRIPQARALLQQCLHARLQIRPADGDVAAQWVEVQRGLVIYVCFFKGADKELLPKMVNTLLNVKLSETENGKHVSILDLPGNILIIPQATLGGRLKGRNMQYHSNSGKEEGFELYSQFVTLCEKEVAANSKCAEARVVVEHGTYGNRQVLKLDTNGPFTHLIEF

SEQ ID NO: 25693 - protein, 168 aa, Homo sapiens; identical to SEQ ID NO: 25692
  Payload ID: 5090
  Gene Symbol: DTD2
  Gene Name: D-tyrosyl-tRNA deacylase 2 (putative)
  Uniprot ID: Q96FN9
  ENSP ID: ENSP00000348503

SEQ ID NO: 25694 - protein, 68 aa, Homo sapiens
  Payload ID: 5090
  Gene Symbol: DTD2
  Gene Name: D-tyrosyl-tRNA deacylase 2 (putative)
  ENSP ID: ENSP00000449624
MAEGSRIPQARALLQQCLHARLQIRPADGDVAAQWVEVTSARQLSLSSGVRGGFFRVVSVTRPLCVSL

SEQ ID NO: 25695 - protein, 263 aa, Homo sapiens
  Payload ID: 5091
  Gene Symbol: DAPP1
  Gene Name: dual adaptor of phosphotyrosine and 3-phosphoinositides
  ENSP ID: ENSP00000296414
MGRAELLEGKMSTQDPSDLWSRSDGEAELLQDLGWYHGNLTRHAAEALLLSNGCDGSYLLRDSNETTGLYSLSVRAKDSVKHFHVEYTGYSFKFGFNEFSSLKDFVKHFANQPLIGSETGTLMVLKHPYPRKVEEPSIYESVRVHTAMQTGRTEDDLVPTAPSLGTKEGYLTKQGGLVKTWKTRWFTLHRNELKYFKDQMSPEPIRILDLTECSAVQFDYSQERVNCFCLVFPFRTFYLCAKTGVEADEWIKILRWKLVKDKS

SEQ ID NO: 25696 - protein, 280 aa, Homo sapiens
  Payload ID: 5091
  Gene Symbol: DAPP1
  Gene Name: dual adaptor of phosphotyrosine and 3-phosphoinositides
  Uniprot ID: Q9UN19
  ENSP ID: ENSP00000423602
MGRAELLEGKMSTQDPSDLWSRSDGEAELLQDLGWYHGNLTRHAAEALLLSNGCDGSYLLRDSNETTGLYSLSVRAKDSVKHFHVEYTGYSFKFGFNEFSSLKDFVKHFANQPLIGSETGTLMVLKHPYPRKVEEPSIYESVRVHTAMQTGRTEDDLVPTAPSLGTKEGYLTKQGGLVKTWKTRWFTLHRNELKYFKDQMSPEPIRILDLTECSAVQFDYSQERVNCFCLVFPFRTFYLCAKTGVEADEWIKILRWKLSQIRKQLNQGEGTIRSRSFIFK

SEQ ID NO: 25697 - protein, 1551 aa, Homo sapiens
  Payload ID: 5092
  Gene Symbol: DUOX1
  Gene Name: dual oxidase 1
  Uniprot ID: Q9NRD9
  ENSP ID: ENSP00000317997
MGFCLALAWTLLVGAWTPLGAQNPISWEVQRFDGWYNNLMEHRWGSKGSRLQRLVPASYADGVYQPLGEPHLPNPRDLSNTISRGPAGLASLRNRTVLGVFFGYHVLSDLVSVETPGCPAEFLNIRIPPGDPMFDPDQRGDVVLPFQRSRWDPETGRSPSNPRDPANQVTGWLDGSAIYGSSHSWSDALRSFSRGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISSEFVAASEQFLSTMVPPGVYMRNASCHFQGVINRNSSVSRALRVCNSYWSREHPSLQSAEDVDALLLGMASQIAEREDHVLVEDVRDFWPGPLKFSRTDHLASCLQRGRDLGLPSYTKARAALGLSPITRWQDINPALSRSNDTVLEATAALYNQDLSWLELLPGGLLESHRDPGPLFSTIVLEQFVRLRDGDRYWFENTRNGLFSKKEIEEIRNTTLQDVLVAVINIDPSALQPNVFVWHKGDPCPQPRQLSTEGLPACAPSVVRDYFEGSGFGFGVTIGTLCCFPLVSLLSAWIVARLRMRNFKRLQGQDRQSIVSEKLVGGMEALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSELPQKYYWWFFQTVPGLTGVVLLLILAIMYVFASHHFRRRSFRGFWLTHHLYILLYVLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 25698 - protein, 1551 aa, Homo sapiens; identical to SEQ ID NO: 25697
  Payload ID: 5092
  Gene Symbol: DUOX1
  Gene Name: dual oxidase 1
  Uniprot ID: Q9NRD9
  ENSP ID: ENSP00000373689

SEQ ID NO: 25699 - protein, 444 aa, Homo sapiens
  Payload ID: 5092
  Gene Symbol: DUOX1
  Gene Name: dual oxidase 1
  ENSP ID: ENSP00000452623
MGFCLALAWTLLVGAWTPLGAQNPISWEVQRFDGWYNNLMEHRWGSKGSRLQRLVPASYADGVYQPLGEPHLPNPRDLSNTISRGPAGLASLRNRTVLGVFFGYHVLSDLVSVETPGCPAEFLNIRIPPGDPMFDPDQRGDVVLPFQRSRWDPETGRSPSNPRDPANQVTGWLDGSAIYGSSHSWSDALRSFSRGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISSEFVAASEQFLSTMVPPGVYMRNASCHFQGVINRNSSVSRALRVCNSYWSREHPSLQSAEDVDALLLGMASQIAEREDHVLVEDVRGTGGHSCPVQPGLILARAAPWGTPGEPPGPWTSVQHHRP

SEQ ID NO: 25700 - protein, 1197 aa, Homo sapiens
  Payload ID: 5092
  Gene Symbol: DUOX1
  Gene Name: dual oxidase 1
  Uniprot ID: Q9NRD9
  ENSP ID: ENSP00000454065
MWMHCCWAWPPRSQSERTMCWLKMCGVSLRLSLQVVNSWPLGRGSAGLPEPDFWPGPLKFSRTDHLASCLQRGRDLGLPSYTKARAALGLSPITRWQDINPALSRSNDTVLEATAALYNQDLSWLELLPGGLLESHRDPGPLFSTIVLEQFVRLRDGDRYWFENTRNGLFSKKEIEEIRNTTLQDVLVAVINIDPSALQPNVFVWHKGDPCPQPRQLSTEGLPACAPSVVRDYFEGSGFGFGVTIGTLCCFPLVSLLSAWIVARLRMRNFKRLQGQDRQSIVSEKLVGGMEALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSELPQKYYWWFFQTVPGLTGVVLLLILAIMYVFASHHFRRRSFRGFWLTHHLYILLYVLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 25701 - protein, 43 aa, Homo sapiens
  Payload ID: 5092
  Gene Symbol: DUOX1
  Gene Name: dual oxidase 1
  ENSP ID: ENSP00000454121
MGFCLALAWTLLVGAWTPLGAQNPISWEVQRFDGWYNNLMEHR

SEQ ID NO: 25702 - protein, 1548 aa, Homo sapiens
  Payload ID: 5093
  Gene Symbol: DUOX2
  Gene Name: dual oxidase 2
  ENSP ID: ENSP00000373691
MLRARPEALMLLGALLTGSLGPSGSQDALSLPWEVQRYDGWFNNLRHHERGAVGCRLQRRVPANYADGVYQALEEPQLPNPRRLSNAATRGIAGLPSLHNRTVLGVFFGYHVLSDVVSVETPGCPAEFLNIRIPPGDPVFDPDQRGDVVLPFQRSRWDPETGRSPSNPRDLANQVTGWLDGSAIYGSSHSWSDALRSFSGGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISPEFVVASEQFFSTMVPPGVYMRNASCHFRKVLNKGFQSSQALRVCNNYWIRENPNLNSTQEVNELLLGMASQISELEDNIVVEDLRDYWPGPGKFSRTDYVASSIQRGRDMGLPSYSQALLAFGLDIPRNWSDLNPNVDPQVLEATAALYNQDLSQLELLLGGLLESHGDPGPLFSAIVLDQFVRLRDGDRYWFENTRNGLFSKKEIEDIRNTTLRDVLVAVINIDPSALQPNVFVWHKGAPCPQPKQLTTDGLPQCAPLTVLDFFEGSSPGFAITIIALCCLPLVSLLLSGVVAYFRGREHKKLQKKLKESVKKEAAKDGVPAMEWPGPKERSSPIIIQLLSDRCLQVLNRHLTVLRVVQLQPLQQVNLILSNNRGCRTLLLKIPKEYDLVLLFSSEEERGAFVQQLWDFCVRWALGLHVAEMSEKELFRKAVTKQQRERILEIFFRHLFAQVLDINQADAGTLPLDSSQKVREALTCELSRAEFAESLGLKPQDMFVESMFSLADKDGNGYLSFREFLDILVVFMKGSPEDKSRLMFTMYDLDENGFLSKDEFFTMMRSFIEISNNCLSKAQLAEVVESMFRESGFQDKEELTWEDFHFMLRDHDSELRFTQLCVKGGGGGGNGIRDIFKQNISCRVSFITRTPGERSHPQGLGPPAPEAPELGGPGLKKRFGKKAAVPTPRLYTEALQEKMQRGFLAQKLQQYKRFVENYRRHIVCVAIFSAICVGVFADRAYYYGFASPPSDIAQTTLVGIILSRGTAASVSFMFSYILLTMCRNLITFLRETFLNRYVPFDAAVDFHRWIAMAAVVLAILHSAGHAVNVYIFSVSPLSLLACIFPNVFVNDGSKLPQKFYWWFFQTVPGMTGVLLLLVLAIMYVFASHHFRRRSFRGFWLTHHLYILLYALLIIHGSYALIQLPTFHIYFLVPAIIYGGDKLVSLSRKKVEISVVKAELLPSGVTYLQFQRPQGFEYKSGQWVRIACLALGTTEYHPFTLTSAPHEDTLSLHIRAVGPWTTRLREIYSSPKGNGCAGYPKLYLDGPFGEGHQEWHKFEVSVLVGGGIGVTPFASILKDLVFKSSLGSQMLCKKIYFIWVTRTQRQFEWLADIIQEVEENDHQDLVSVHIYVTQLAEKFDLRTTMLYICERHFQKVLNRSLFTGLRSITHFGRPPFEPFFNSLQEVHPQVRKIGVFSCGPPGMTKNVEKACQLVNRQDRAHFMHHYENF

SEQ ID NO: 25703 - protein, 1548 aa, Homo sapiens
  Payload ID: 5093
  Gene Symbol: DUOX2
  Gene Name: dual oxidase 2
  Uniprot ID: Q9NRD8
  ENSP ID: ENSP00000475084
MLRARPEALMLLGALLTGSLGPSGNQDALSLPWEVQRYDGWFNNLRHHERGAVGCRLQRRVPANYADGVYQALEEPQLPNPRRLSNAATRGIAGLPSLHNRTVLGVFFGYHVLSDVVSVETPGCPAEFLNIRIPPGDPVFDPDQRGDVVLPFQRSRWDPETGRSPSNPRDLANQVTGWLDGSAIYGSSHSWSDALRSFSGGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISPEFVVASEQFFSTMVPPGVYMRNASCHFRKVLNKGFQSSQALRVCNNYWIRENPNLNSTQEVNELLLGMASQISELEDNIVVEDLRDYWPGPGKFSRTDYVASSIQRGRDMGLPSYSQALLAFGLDIPRNWSDLNPNVDPQVLEATAALYNQDLSQLELLLGGLLESHGDPGPLFSAIVLDQFVRLRDGDRYWFENTRNGLFSKKEIEDIRNTTLRDVLVAVINIDPSALQPNVFVWHKGAPCPQPKQLTTDGLPQCAPLTVLDFFEGSSPGFAITIIALCCLPLVSLLLSGVVAYFRGREHKKLQKKLKESVKKEAAKDGVPAMEWPGPKERSSPIIIQLLSDRCLQVLNRHLTVLRVVQLQPLQQVNLILSNNRGCRTLLLKIPKEYDLVLLFSSEEERGAFVQQLWDFCVRWALGLHVAEMSEKELFRKAVTKQQRERILEIFFRHLFAQVLDINQADAGTLPLDSSQKVREALTCELSRAEFAESLGLKPQDMFVESMFSLADKDGNGYLSFREFLDILVVFMKGSPEDKSRLMFTMYDLDENGFLSKDEFFTMMRSFIEISNNCLSKAQLAEVVESMFRESGFQDKEELTWEDFHFMLRDHDSELRFTQLCVKGGGGGGNGIRDIFKQNISCRVSFITRTPGERSHPQGLGPPAPEAPELGGPGLKKRFGKKAAVPTPRLYTEALQEKMQRGFLAQKLQQYKRFVENYRRHIVCVAIFSAICVGVFADRAYYYGFASPPSDIAQTTLVGIILSRGTAASVSFMFSYILLTMCRNLITFLRETFLNRYVPFDAAVDFHRWIAMAAVVLAILHSAGHAVNVYIFSVSPLSLLACIFPNVFVNDGSKLPQKFYWWFFQTVPGMTGVLLLLVLAIMYVFASHHFRRRSFRGFWLTHHLYILLYALLIIHGSYALIQLPTFHIYFLVPAIIYGGDKLVSLSRKKVEISVVKAELLPSGVTYLQFQRPQGFEYKSGQWVRIACLALGTTEYHPFTLTSAPHEDTLSLHIRAVGPWTTRLREIYSSPKGNGCAGYPKLYLDGPFGEGHQEWHKFEVSVLVGGGIGVTPFASILKDLVFKSSLGSQMLCKKIYFIWVTRTQRQFEWLADIIQEVEENDHQDLVSVHIYVTQLAEKFDLRTTMLYICERHFQKVLNRSLFTGLRSITHFGRPPFEPFFNSLQEVHPQVRKIGVFSCGPPGMTKNVEKACQLVNRQDRAHFMHHYENF

SEQ ID NO: 25704 - protein, 483 aa, Homo sapiens
  Payload ID: 5094
  Gene Symbol: DUOXA1
  Gene Name: dual oxidase maturation factor 1
  Uniprot ID: Q1HG43
  ENSP ID: ENSP00000267803
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYYRPRRLSLVPADVRGLAPAALSALPGALLAQAWRALLPGLRCPKAGKESRLGPPHSPWRFGPEGCEERWAEHTGDSPRPLRGRGTGRLWRWGSKERRACGVRAMLPRLVSNSGLKRPSCLDLPKCWDYRRDARAFFHLLEPTPCVTSRHTPLI

SEQ ID NO: 25705 - protein, 438 aa, Homo sapiens
  Payload ID: 5094
  Gene Symbol: DUOXA1
  Gene Name: dual oxidase maturation factor 1
  ENSP ID: ENSP00000415512
MATLGHTFPFYAGPKPTFPMDTTLASIIMIFLTALATFIVILPGIRGKTRLFWLLRVVTSLFIGAAILGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYYRPRRLSLVPADVRGLAPAALSALPGALLAQAWRALLPGLRCPKAGKESRLGPPHSPWRFGPEGCEERWAEHTGDSPRPLRGRGTGRLWRWGSKERRACGVRAMLPRLVSNSGLKRPSCLDLPKCWDYRRDARAFFHLLEPTPCVTSRHTPLI

SEQ ID NO: 25706 - protein, 71 aa, Homo sapiens
  Payload ID: 5094
  Gene Symbol: DUOXA1
  Gene Name: dual oxidase maturation factor 1
  ENSP ID: ENSP00000452782
MATLGHTFPFYAGPKPTFPMDTTLASIIMIFLTALATFIVILPGIRGKTRLFWLLRVVTSLFIGAAILGTP

SEQ ID NO: 25707 - protein, 15 aa, Homo sapiens
  Payload ID: 5094
  Gene Symbol: DUOXA1
  Gene Name: dual oxidase maturation factor 1
  ENSP ID: ENSP00000452795
MATLGHTFPFYAGPK

SEQ ID NO: 25708 - protein, 12 aa, Homo sapiens
  Payload ID: 5094
  Gene Symbol: DUOXA1
  Gene Name: dual oxidase maturation factor 1
  ENSP ID: ENSP00000453217
MATLGHTFPFYA

SEQ ID NO: 25709 - protein, 72 aa, Homo sapiens
  Payload ID: 5094
  Gene Symbol: DUOXA1
  Gene Name: dual oxidase maturation factor 1
  ENSP ID: ENSP00000453295
MATLGHTFPFYAGPKPTFPMDTTLASIIMIFLTALATFIVILPGIRGKTRLFWLLRVVTSLFIGAAILAVNF

SEQ ID NO: 25710 - protein, 483 aa, Homo sapiens; identical to SEQ ID NO: 25704
  Payload ID: 5094
  Gene Symbol: DUOXA1
  Gene Name: dual oxidase maturation factor 1
  Uniprot ID: Q1HG43
  ENSP ID: ENSP00000453569

SEQ ID NO: 25711 - protein, 166 aa, Homo sapiens
  Payload ID: 5094
  Gene Symbol: DUOXA1
  Gene Name: dual oxidase maturation factor 1
  ENSP ID: ENSP00000453614
  MOD_RES (1)..(1): Any amino acid
XTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLNETINYNEEFTWRLGENYAEEYAKALEKGLPDPVLYLAEKFTPRSPCGLYRQYRLAGHYTSAMLCR

SEQ ID NO: 25712 - protein, 121 aa, Homo sapiens
  Payload ID: 5094
  Gene Symbol: DUOXA1
  Gene Name: dual oxidase maturation factor 1
  ENSP ID: ENSP00000453809
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLN

SEQ ID NO: 25713 - protein, 298 aa, Homo sapiens
  Payload ID: 5094
  Gene Symbol: DUOXA1
  Gene Name: dual oxidase maturation factor 1
  Uniprot ID: Q1HG43
  ENSP ID: ENSP00000453836
MATLGHTFPFYAGPKPTFPMDTTLASIIMIFLTALATFIVILPGIRGKTRLFWLLRVVTSLFIGAAILGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYCKEAHPKDPDCAL

SEQ ID NO: 25714 - protein, 298 aa, Homo sapiens; identical to SEQ ID NO: 25713
  Payload ID: 5094
  Gene Symbol: DUOXA1
  Gene Name: dual oxidase maturation factor 1
  Uniprot ID: Q1HG43
  ENSP ID: ENSP00000454019

SEQ ID NO: 25715 - protein, 343 aa, Homo sapiens
  Payload ID: 5094
  Gene Symbol: DUOXA1
  Gene Name: dual oxidase maturation factor 1
  Uniprot ID: Q1HG43
  ENSP ID: ENSP00000454084
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYCKEAHPKDPDCAL

SEQ ID NO: 25716 - protein, 77 aa, Homo sapiens
  Payload ID: 5094
  Gene Symbol: DUOXA1
  Gene Name: dual oxidase maturation factor 1
  ENSP ID: ENSP00000454117
MATLGHTFPFYAGPKPTFPMDTTLASIIMIFLTALATFIVILPGIRGKTRLFWLLRVVTSLFIGAAILGTPVQQLNE

SEQ ID NO: 25717 - protein, 438 aa, Homo sapiens; identical to SEQ ID NO: 25705
  Payload ID: 5094
  Gene Symbol: DUOXA1
  Gene Name: dual oxidase maturation factor 1
  ENSP ID: ENSP00000480154

SEQ ID NO: 25718 - protein, 320 aa, Homo sapiens
  Payload ID: 5095
  Gene Symbol: DUOXA2
  Gene Name: dual oxidase maturation factor 2
  Uniprot ID: Q1HG44
  ENSP ID: ENSP00000319705
MTLWNGVLPFYPQPRHAAGFSVPLLIVILVFLALAASFLLILPGIRGHSRWFWLVRVLLSLFIGAEIVAVHFSAEWFVGTVNTNTSYKAFSAARVTARVRLLVGLEGINITLTGTPVHQLNETIDYNEQFTWRLKENYAAEYANALEKGLPDPVLYLAEKFTPSSPCGLYHQYHLAGHYASATLWVAFCFWLLSNVLLSTPAPLYGGLALLTTGAFALFGVFALASISSVPLCPLRLGSSALTTQYGAAFWVTLATGVLCLFLGGAVVSLQYVRPSALRTLLDQSAKDCSQERGGSPLILGDPLHKQAALPDLKCITTNL

SEQ ID NO: 25719 - protein, 121 aa, Homo sapiens
  Payload ID: 5095
  Gene Symbol: DUOXA2
  Gene Name: dual oxidase maturation factor 2
  Uniprot ID: Q1HG44
  ENSP ID: ENSP00000454110
MTLWNGVLPFYPQPRHAAGFSVPLLIVILVFLALAASFLLILPGIRGHSEYLHSHLLPSEIRLGPPSSEGGDPCVPSTSGLTEPHQAVTGPGGRTRTRRQTARGVKVVEECQEVGVEGRCC

SEQ ID NO: 25720 - protein, 884 aa, Homo sapiens
  Payload ID: 5096
  Gene Symbol: DSTYK
  Gene Name: dual serine/threonine and tyrosine protein kinase
  Uniprot ID: Q6XUX3
  ENSP ID: ENSP00000356129
MEGDGVPWGSEPVSGPGPGGGGMIRELCRGFGRYRRYLGRLRQNLRETQKFFRDIKCSHNHTCLSSLTGGGGAERGPAGDVAETGLQAGQLSCISFPPKEEKYLQQIVDCLPCILILGQDCNVKCQLLNLLLGVQVLPTTKLGSEESCKLRRLRFTYGTQTRVSLALPGQYELVHTLVAHQGNWETIPEEDLEVQENNEDAAHVLAELEVTMHHALLQEVDVVVAPCQGLRPTVDVLGDLVNDFLPVITYALHKDELSERDEQELQEIRKYFSFPVFFFKVPKLGSEIIDSSTRRMESERSPLYRQLIDLGYLSSSHWNCGAPGQDTKAQSMLVEQSEKLRHLSTFSHQVLQTRLVDAAKALNLVHCHCLDIFINQAFDMQRDLQITPKRLEYTRKKENELYESLMNIANRKQEEMKDMIVETLNTMKEELLDDATNMEFKDVIVPENGEPVGTREIKCCIRQIQELIISRLNQAVANKLISSVDYLRESFVGTLERCLQSLEKSQDVSVHITSNYLKQILNAAYHVEVTFHSGSSVTRMLWEQIKQIIQRITWVSPPAITLEWKRKVAQEAIESLSASKLAKSICSQFRTRLNSSHEAFAASLRQLEAGHSGRLEKTEDLWLRVRKDHAPRLARLSLESCSLQDVLLHRKPKLGQELGRGQYGVVYLCDNWGGHFPCALKSVVPPDEKHWNDLALEFHYMRSLPKHERLVDLHGSVIDYNYGGGSSIAVLLIMERLHRDLYTGLKAGLTLETRLQIALDVVEGIRFLHSQGLVHRDIKLKNVLLDKQNRAKITDLGFCKPEAMMSGSIVGTPIHMAPELFTGARPERLPVFDEECWQLMEACWDGDPLKRPLLGIVQPMLQGIMNRLCKSNSEQPNRGLDDST

SEQ ID NO: 25721 - protein, 929 aa, Homo sapiens
  Payload ID: 5096
  Gene Symbol: DSTYK
  Gene Name: dual serine/threonine and tyrosine protein kinase
  Uniprot ID: Q6XUX3
  ENSP ID: ENSP00000356130
MEGDGVPWGSEPVSGPGPGGGGMIRELCRGFGRYRRYLGRLRQNLRETQKFFRDIKCSHNHTCLSSLTGGGGAERGPAGDVAETGLQAGQLSCISFPPKEEKYLQQIVDCLPCILILGQDCNVKCQLLNLLLGVQVLPTTKLGSEESCKLRRLRFTYGTQTRVSLALPGQYELVHTLVAHQGNWETIPEEDLEVQENNEDAAHVLAELEVTMHHALLQEVDVVVAPCQGLRPTVDVLGDLVNDFLPVITYALHKDELSERDEQELQEIRKYFSFPVFFFKVPKLGSEIIDSSTRRMESERSPLYRQLIDLGYLSSSHWNCGAPGQDTKAQSMLVEQSEKLRHLSTFSHQVLQTRLVDAAKALNLVHCHCLDIFINQAFDMQRDLQITPKRLEYTRKKENELYESLMNIANRKQEEMKDMIVETLNTMKEELLDDATNMEFKDVIVPENGEPVGTREIKCCIRQIQELIISRLNQAVANKLISSVDYLRESFVGTLERCLQSLEKSQDVSVHITSNYLKQILNAAYHVEVTFHSGSSVTRMLWEQIKQIIQRITWVSPPAITLEWKRKVAQEAIESLSASKLAKSICSQFRTRLNSSHEAFAASLRQLEAGHSGRLEKTEDLWLRVRKDHAPRLARLSLESCSLQDVLLHRKPKLGQELGRGQYGVVYLCDNWGGHFPCALKSVVPPDEKHWNDLALEFHYMRSLPKHERLVDLHGSVIDYNYGGGSSIAVLLIMERLHRDLYTGLKAGLTLETRLQIALDVVEGIRFLHSQGLVHRDIKLKNVLLDKQNRAKITDLGFCKPEAMMSGSIVGTPIHMAPELFTGKYDNSVDVYAFGILFWYICSGSVKLPEAFERCASKDHLWNNVRRGARPERLPVFDEECWQLMEACWDGDPLKRPLLGIVQPMLQGIMNRLCKSNSEQPNRGLDDST

SEQ ID NO: 25722 - protein, 179 aa, Homo sapiens
  Payload ID: 5096
  Gene Symbol: DSTYK
  Gene Name: dual serine/threonine and tyrosine protein kinase
  Uniprot ID: Q6XUX3
  ENSP ID: ENSP00000478016
MLWEQIKQIIQRITWVSPPAITLEWKRKVAQEAIESLSASKLAKSICSQFRTRLNSSHEAFAASLRQLEAGHSGRLEKTEDLWLRVRKDHAPRLARLSLESCSLQDVLLHRKPKLGQELGRGQYGVVYLCDNWGGHFPCALKSVVPPDEKHWNDLALEFHYMRWVLASFISMRKIQRRI

SEQ ID NO: 25723 - protein, 367 aa, Homo sapiens
  Payload ID: 5097
  Gene Symbol: DUSP1
  Gene Name: dual specificity phosphatase 1
  Uniprot ID: P28562
  ENSP ID: ENSP00000239223
MVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 25724 - protein, 482 aa, Homo sapiens
  Payload ID: 5098
  Gene Symbol: DUSP10
  Gene Name: dual specificity phosphatase 10
  Uniprot ID: Q9Y6W6
  ENSP ID: ENSP00000355866
MPPSPLDDRVVVALSRPVRPQDLNLCLDSSYLGSANPGSNSHPPVIATTVVSLKAANLTYMPSSSGSARSLNCGCSSASCCTVATYDKDNQAQTQAIAAGTTTTAIGTSTTCPANQMVNNNENTGSLSPSSGVGSPVSGTPKQLASIKIIYPNDLAKKMTKCSKSHLPSQGPVIIDCRPFMEYNKSHIQGAVHINCADKISRRRLQQGKITVLDLISCREGKDSFKRIFSKEIIVYDENTNEPSRVMPSQPLHIVLESLKREGKEPLVLKGGLSSFKQNHENLCDNSLQLQECREVGGGASAASSLLPQPIPTTPDIENAELTPILPFLFLGNEQDAQDLDTMQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 25725 - protein, 66 aa, Homo sapiens
  Payload ID: 5098
  Gene Symbol: DUSP10
  Gene Name: dual specificity phosphatase 10
  ENSP ID: ENSP00000480008
MKTSVTTPSSSKSAGRWGAAHPRPRACYLSPSPPPLTSRTLSSPPSCPSCSLAMSRMLRTWTPCSG

SEQ ID NO: 25726 - protein, 66 aa, Homo sapiens; identical to SEQ ID NO: 25725
  Payload ID: 5098
  Gene Symbol: DUSP10
  Gene Name: dual specificity phosphatase 10
  ENSP ID: ENSP00000482935

SEQ ID NO: 25727 - protein, 66 aa, Homo sapiens; identical to SEQ ID NO: 25725
  Payload ID: 5098
  Gene Symbol: DUSP10
  Gene Name: dual specificity phosphatase 10
  ENSP ID: ENSP00000483812

SEQ ID NO: 25728 - protein, 377 aa, Homo sapiens
  Payload ID: 5099
  Gene Symbol: DUSP11
  Gene Name: dual specificity phosphatase 11 (RNA/RNP complex 1-interacting)
  Uniprot ID: O75319
  ENSP ID: ENSP00000272444
MRNSETLERGVGGCRVFSCLGSYPGIEGAGLALLADLALGGRLLGTHMSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRYLIDVEGVRPDDAIELFNRCRGHCLERQNYIEDLQNGPIRKNWNSSVPRSSDFEDSAHLMQPVHNKPVKQGPRYNLHQIQGHSAPRHFHTQTQSLQQSVRKFSENPHVYQRHHLPPPGPPGEDYSHRRYSWNVKPNASRAAQDRRRWYPYNYSRLSYPACWEWTQ

SEQ ID NO: 25729 - protein, 150 aa, Homo sapiens
  Payload ID: 5099
  Gene Symbol: DUSP11
  Gene Name: dual specificity phosphatase 11 (RNA/RNP complex 1-interacting)
  ENSP ID: ENSP00000394535
QWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNEVRSRRKD

SEQ ID NO: 25730 - protein, 273 aa, Homo sapiens
  Payload ID: 5099
  Gene Symbol: DUSP11
  Gene Name: dual specificity phosphatase 11 (RNA/RNP complex 1-interacting)
  ENSP ID: ENSP00000413444
MRNSETLERGVGGCRVFSCLGSYPGIEGAGLALLADLALGGRLLGTHMSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRRSLALSPRLECSGTISTHSKFCFPGSRRSPASASQVAGTTGARHHARLIFCIFSRDVVSPC

SEQ ID NO: 25731 - protein, 340 aa, Homo sapiens
  Payload ID: 5100
  Gene Symbol: DUSP12
  Gene Name: dual specificity phosphatase 12
  Uniprot ID: Q9UNI6
  ENSP ID: ENSP00000356920
MLEAPGPSDGCELSNPSASRVSCAGQMLEVQPGLYFGGAAAVAEPDHLREAGITAVLTVDSEEPSFKAGPGVEDLWRLFVPALDKPETDLLSHLDRCVAFIGQARAEGRAVLVHCHAGVSRSVAIITAFLMKTDQLPFEKAYEKLQILKPEAKMNEGFEWQLKLYQAMGYEVDTSSAIYKQYRLQKVTEKYPELQNLPQELFAVDPTTVSQGLKDEVLYKCRKCRRSLFRSSSILDHREGSGPIAFAHKRMTPSSMLTTGRQAQCTSYFIEPVQWMESALLGVMDGQLLCPKCSAKLGSFNWYGEQCSCGRWITPAFQIHKNRVDEMKILPVLGSQTGKI

SEQ ID NO: 25732 - protein, 137 aa, Homo sapiens
  Payload ID: 5100
  Gene Symbol: DUSP12
  Gene Name: dual specificity phosphatase 12
  ENSP ID: ENSP00000476528
MLEAPGPSDGCELSNPSASRVSCAGQMLEVQPGLYFGGAAAVAEPDHLREAGITAVLTVDSEEPSFKAGPGVEDLWRLFVPALDKPETDLLSHLDRCVAFIGQARAEGRAVLVHWSLFQSCRSQSKCGHNNCFSHED

SEQ ID NO: 25733 - protein, 137 aa, Homo sapiens; identical to SEQ ID NO: 25732
  Payload ID: 5100
  Gene Symbol: DUSP12
  Gene Name: dual specificity phosphatase 12
  ENSP ID: ENSP00000476912

SEQ ID NO: 25734 - protein, 82 aa, Homo sapiens
  Payload ID: 5100
  Gene Symbol: DUSP12
  Gene Name: dual specificity phosphatase 12
  ENSP ID: ENSP00000477122
MLEVQPGLYFGGAAAVAEPDHLREAGITAVLTVDSEEPSFKAGPGVEDLWRLFVPALDKPETDLLSHLDRVLLCHPGYSVVA

SEQ ID NO: 25735 - protein, 60 aa, Homo sapiens
  Payload ID: 5101
  Gene Symbol: DUSP13
  Gene Name: dual specificity phosphatase 13
  Uniprot ID: Q6B8I1
  ENSP ID: ENSP00000311051
MAETSLPELGGEDKATPCPSILELEELLRAGKSSCSRVDEVWPNLFIGDANSIKCAETGG

SEQ ID NO: 25736 - protein, 248 aa, Homo sapiens
  Payload ID: 5101
  Gene Symbol: DUSP13
  Gene Name: dual specificity phosphatase 13
  Uniprot ID: Q9UII6
  ENSP ID: ENSP00000361785
MAETSLPELGGEDKATPCPSILELEELLRAGKSSCSRVDEVWPNLFIGDAMDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 25737 - protein, 188 aa, Homo sapiens
  Payload ID: 5101
  Gene Symbol: DUSP13
  Gene Name: dual specificity phosphatase 13
  Uniprot ID: Q6B8I1
  ENSP ID: ENSP00000361787
MAETSLPELGGEDKATPCPSILELEELLRAGKSSCSRVDEVWPNLFIGDAATANNRFELWKLGITHVLNAAHKGLYCQGGPDFYGSSVSYLGVPAHDLPDFDISAYFSSAADFIHRALNTPGAKVLVHCVVGVSRSATLVLAYLMLHQRLSLRQAVITVRQHRWVFPNRGFLHQLCRLDQQLRGAGQS

SEQ ID NO: 25738 - protein, 147 aa, Homo sapiens
  Payload ID: 5101
  Gene Symbol: DUSP13
  Gene Name: dual specificity phosphatase 13
  ENSP ID: ENSP00000434041
MDSLQKQDLRRPKIHGAVQASPYQPPTLASLQRLLWVRQAATLNHIDEVWPSLFLGDAYAARDKSKLIQLGITHVVNAAAGRVLVHCAMGVSRSATLVLAFLMICENMTLVEAIQTVQAHRNICPNSGFLRQLQVLDNRLGRETGRF

SEQ ID NO: 25739 - protein, 198 aa, Homo sapiens
  Payload ID: 5101
  Gene Symbol: DUSP13
  Gene Name: dual specificity phosphatase 13
  Uniprot ID: Q9UII6
  ENSP ID: ENSP00000436312
MDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 25740 - protein, 198 aa, Homo sapiens; identical to SEQ ID NO: 25739
  Payload ID: 5101
  Gene Symbol: DUSP13
  Gene Name: dual specificity phosphatase 13
  Uniprot ID: Q9UII6
  ENSP ID: ENSP00000444580

SEQ ID NO: 25741 - protein, 67 aa, Homo sapiens
  Payload ID: 5101
  Gene Symbol: DUSP13
  Gene Name: dual specificity phosphatase 13
  Uniprot ID: Q6B8I1
  ENSP ID: ENSP00000452702
MAETSLPELGGEDKATPCPSILELEELLRAGKSSCSRVDEVWPNLFIGDAAGPYSLPWGSATLPPWH

SEQ ID NO: 25742 - protein, 166 aa, Homo sapiens
  Payload ID: 5101
  Gene Symbol: DUSP13
  Gene Name: dual specificity phosphatase 13
  Uniprot ID: Q6B8I1
  ENSP ID: ENSP00000474298
MAETSLPELGGEDKATPCPSILELEELLRAGKSSCSRVDEVWPNLFIGDAATANNRFELWKLGITHVLNAAHKGLYCQGGPDFYGSSVSYLGVPAHDLPDFDISAYFSSAADFIHRALNTPGELVLTPCHGALPLCHPGTDPAGAAGGSGPGGHTEDGGSPAWGRP

SEQ ID NO: 25743 - protein, 92 aa, Homo sapiens
  Payload ID: 5101
  Gene Symbol: DUSP13
  Gene Name: dual specificity phosphatase 13
  Uniprot ID: Q6B8I1
  ENSP ID: ENSP00000474689
MAETSLPELGGEDKATPCPSILELEELLRAGKSSCSRVDEVWPNLFIGDARGPGTASLLVPWLGRHQVPFLPSPGPRQTTALSCGSWASPTC

SEQ ID NO: 25744 - protein, 334 aa, Homo sapiens
  Payload ID: 5101
  Gene Symbol: DUSP13
  Gene Name: dual specificity phosphatase 13
  ENSP ID: ENSP00000475626
MPQVGGRPLSHLERSQWGMRRTAWSSLPPCPTASHWVSLAKPAASWVPVSFSGPGTAYQREKMFFPVCTFPSHWSRGSGAVSKDRTPSPTRHQAHILVPLKIQLRRVPDSFSQQMPETSYLTRVGPDIQCWPESWGMDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 25745 - protein, 220 aa, Homo sapiens
  Payload ID: 5101
  Gene Symbol: DUSP13
  Gene Name: dual specificity phosphatase 13
  ENSP ID: ENSP00000475675
MPETSYLTRVGPDIQCWPESWGMDSLQKQDLRRPKIHGAVQASPYQPPTLASLQRLLWVRQAATLNHIDEVWPSLFLGDAYAARDKSKLIQLGITHVVNAAAGKFQVDTGAKFYRGMSLEYYGIEADDNPFFDLSVYFLPVARYIRAALSVPQGRVLVHCAMGVSRSATLVLAFLMICENMTLVEAIQTVQAHRNICPNSGFLRQLQVLDNRLGRETGRF

SEQ ID NO: 25746 - protein, 193 aa, Homo sapiens
  Payload ID: 5101
  Gene Symbol: DUSP13
  Gene Name: dual specificity phosphatase 13
  ENSP ID: ENSP00000475732
MAETSLPELGGEDKATPCPSILELEELLRAGKSSCSRVDEVWPNLFIGDAQGPGALCGGREPLCHAGPGLPHAAPAAVPAPGGDHREAAPMGLPQPRLPAPALQAGPATAGCRPELRGQSWSLLPAMGLCHFATLALILLVLLEALAQADTQKMVEAQRGVGPRACYSIWLLLAPTPPLSHCLQSPQKQHQVC

SEQ ID NO: 25747 - protein, 198 aa, Homo sapiens; identical to SEQ ID NO: 25739
  Payload ID: 5101
  Gene Symbol: DUSP13
  Gene Name: dual specificity phosphatase 13
  Uniprot ID: Q9UII6
  ENSP ID: ENSP00000475801

SEQ ID NO: 25748 - protein, 260 aa, Homo sapiens
  Payload ID: 5101
  Gene Symbol: DUSP13
  Gene Name: dual specificity phosphatase 13
  ENSP ID: ENSP00000475851
LGGEDKATPCPSILELEELLRAGKSSCSRVDEVWPNLFIGDAQGPGALCGGREPLCHAGPGLPHAAPAAVPAPGGDHREAAPMGLPQPRLPAPALQAGPATAGCRPELRGQSWSLLPAMGLCHFATLALILLVLLEALAQADTQKMKQHQVCGDRRLKASSTNCPSEKCTAWARYSHRMDSLQKQDLRRPKIHGAVQASPYQPPTLASLQRLLWVRQAATLNHIDEVWPSLFLGDAYAARDKSKLIQLGITHVVNAAAGK

SEQ ID NO: 25749 - protein, 198 aa, Homo sapiens
  Payload ID: 5102
  Gene Symbol: DUSP14
  Gene Name: dual specificity phosphatase 14
  Uniprot ID: O95147
  ENSP ID: ENSP00000477653
MSSRGHSTLPRTLMAPRMISEGDIGGIAQITSSLFLGRGSVASNRHLLQARGITCIVNATIEIPNFNWPQFEYVKVPLADMPHAPIGLYFDTVADKIHSVSRKHGATLVHCAAGVSRSATLCIAYLMKFHNVCLLEAYNWVKARRPVIRPNVGFWRQLIDYERQLFGKSTVKMVQTPYGIVPDVYEKESRHLMPYWGI

SEQ ID NO: 25750 - protein, 198 aa, Homo sapiens; identical to SEQ ID NO: 25749
  Payload ID: 5102
  Gene Symbol: DUSP14
  Gene Name: dual specificity phosphatase 14
  Uniprot ID: O95147
  ENSP ID: ENSP00000478406

SEQ ID NO: 25751 - protein, 198 aa, Homo sapiens; identical to SEQ ID NO: 25749
  Payload ID: 5102
  Gene Symbol: DUSP14
  Gene Name: dual specificity phosphatase 14
  Uniprot ID: O95147
  ENSP ID: ENSP00000478595

SEQ ID NO: 25752 - protein, 198 aa, Homo sapiens; identical to SEQ ID NO: 25749
  Payload ID: 5102
  Gene Symbol: DUSP14
  Gene Name: dual specificity phosphatase 14
  Uniprot ID: O95147
  ENSP ID: ENSP00000484091

SEQ ID NO: 25753 - protein, 198 aa, Homo sapiens; identical to SEQ ID NO: 25749
  Payload ID: 5102
  Gene Symbol: DUSP14
  Gene Name: dual specificity phosphatase 14
  ENSP ID: ENSP00000487886

SEQ ID NO: 25754 - protein, 198 aa, Homo sapiens; identical to SEQ ID NO: 25749
  Payload ID: 5102
  Gene Symbol: DUSP14
  Gene Name: dual specificity phosphatase 14
  ENSP ID: ENSP00000488882

SEQ ID NO: 25755 - protein, 295 aa, Homo sapiens
  Payload ID: 5103
  Gene Symbol: DUSP15
  Gene Name: dual specificity phosphatase 15
  Uniprot ID: Q9H1R2
  ENSP ID: ENSP00000278979
MTEGVLPGLYLGNFIDAKDLDQLGRNKITHIISIHESPQPLLQDITYLRIPVADTPEVPIKKHFKECINFIHCCRLNGGNCLVHCFAGISRSTTIVTAYVMTVTGLGWRDVLEAIKATRPIANPNPGFRQQLEEFGWASSQKGARHRTSKTSGAQCPPMTSATCLLAARVALLSAALVREATGRTAQRCRLSPRAAAERLLGPPPHVAAGWSPDPKYQICLCFGEEDPGPTQHPKEQLIMADVQVQLRPGSSSCTLSASTERPDGSSTPGNPDGITHLQCSCLHPKRAASSSCTR

SEQ ID NO: 25756 - protein, 235 aa, Homo sapiens
  Payload ID: 5103
  Gene Symbol: DUSP15
  Gene Name: dual specificity phosphatase 15
  Uniprot ID: Q9H1R2
  ENSP ID: ENSP00000341658
MGNGMTKVLPGLYLGNFIDAKDLDQLGRNKITHIISIHESPQPLLQDITYLRIPVADTPEVPIKKHFKECINFIHCCRLNGGNCLVHCFAGISRSTTIVTAYVMTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 25757 - protein, 232 aa, Homo sapiens
  Payload ID: 5103
  Gene Symbol: DUSP15
  Gene Name: dual specificity phosphatase 15
  Uniprot ID: Q9H1R2
  ENSP ID: ENSP00000365133
MTEGVLPGLYLGNFIDAKDLDQLGRNKITHIISIHESPQPLLQDITYLRIPVADTPEVPIKKHFKECINFIHCCRLNGGNCLVHCFAGISRSTTIVTAYVMTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 25758 - protein, 132 aa, Homo sapiens
  Payload ID: 5103
  Gene Symbol: DUSP15
  Gene Name: dual specificity phosphatase 15
  Uniprot ID: Q9H1R2
  ENSP ID: ENSP00000381157
MTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 25759 - protein, 132 aa, Homo sapiens; identical to SEQ ID NO: 25758
  Payload ID: 5103
  Gene Symbol: DUSP15
  Gene Name: dual specificity phosphatase 15
  Uniprot ID: Q9H1R2
  ENSP ID: ENSP00000381158

SEQ ID NO: 25760 - protein, 76 aa, Homo sapiens
  Payload ID: 5103
  Gene Symbol: DUSP15
  Gene Name: dual specificity phosphatase 15
  ENSP ID: ENSP00000390355
MGNGMTKMPKTWISWAEIRSHTSSLSMSHPSLCCRISPTFASRSLIPLRYPSKSTSKNVSTSSTAAALMGGTALCT

SEQ ID NO: 25761 - protein, 93 aa, Homo sapiens
  Payload ID: 5103
  Gene Symbol: DUSP15
  Gene Name: dual specificity phosphatase 15
  ENSP ID: ENSP00000397486
  MOD_RES (1)..(1): Any amino acid
XTRLPPGGWSPDPKYQICLCFGEEDPGPTQHPKEQLIMADVQVQLRPGSSSCTLSASTERPDGSSTPGNPDGITHLQCSCLHPKRAASSSCTR

SEQ ID NO: 25762 - protein, 132 aa, Homo sapiens; identical to SEQ ID NO: 25758
  Payload ID: 5103
  Gene Symbol: DUSP15
  Gene Name: dual specificity phosphatase 15
  Uniprot ID: Q9H1R2
  ENSP ID: ENSP00000419818

SEQ ID NO: 25763 - protein, 143 aa, Homo sapiens
  Payload ID: 5104
  Gene Symbol: DUSP16
  Gene Name: dual specificity phosphatase 16
  Uniprot ID: Q9BY84
  ENSP ID: ENSP00000228862
MAHEMIGTQIVTERLVALLESGTEKVLLIDSRPFVEYNTSHILEAININCSKLMKRRLQQDKVLITELIQHSAKHKVDIDCSQKVVVYDQSSQDVASLSSDCFLTVLLGKLEKSFNSVHLLAGADAAEWDWLCVKCQQYLSKA

SEQ ID NO: 25764 - protein, 665 aa, Homo sapiens
  Payload ID: 5104
  Gene Symbol: DUSP16
  Gene Name: dual specificity phosphatase 16
  Uniprot ID: Q9BY84
  ENSP ID: ENSP00000298573
MAHEMIGTQIVTERLVALLESGTEKVLLIDSRPFVEYNTSHILEAININCSKLMKRRLQQDKVLITELIQHSAKHKVDIDCSQKVVVYDQSSQDVASLSSDCFLTVLLGKLEKSFNSVHLLAGGFAEFSRCFPGLCEGKSTLVPTCISQPCLPVANIGPTRILPNLYLGCQRDVLNKELMQQNGIGYVLNASNTCPKPDFIPESHFLRVPVNDSFCEKILPWLDKSVDFIEKAKASNGCVLVHCLAGISRSATIAIAYIMKRMDMSLDEAYRFVKEKRPTISPNFNFLGQLLDYEKKIKNQTGASGPKSKLKLLHLEKPNEPVPAVSEGGQKSETPLSPPCADSATSEAAGQRPVHPASVPSVPSVQPSLLEDSPLVQALSGLHLSADRLEDSNKLKRSFSLDIKSVSYSASMAASLHGFSSSEDALEYYKPSTTLDGTNKLCQFSPVQELSEQTPETSPDKEEASIPKKLQTARPSDSQSKRLHSVRTSSSGTAQRSLLSPLHRSGSVEDNYHTSFLFGLSTSQQHLTKSAGLGLKGWHSDILAPQTSTPSLTSSWYFATESSHFYSASAIYGGSASYSAYSCSQLPTCGDQVYSVRRRQKPSDRADSRRSWHEESPFEKQFKRRSCQMEFGESIMSENRSREELGKVGSQSSFSGSMEIIEVS

SEQ ID NO: 25765 - protein, 6 aa, Homo sapiens
  Payload ID: 5104
  Gene Symbol: DUSP16
  Gene Name: dual specificity phosphatase 16
  ENSP ID: ENSP00000441250
MAHEMI

SEQ ID NO: 25766 - protein, 25 aa, Homo sapiens
  Payload ID: 5104
  Gene Symbol: DUSP16
  Gene Name: dual specificity phosphatase 16
  ENSP ID: ENSP00000443039
MAHEMIGTQIVTERLVALLESGTEK

SEQ ID NO: 25767 - protein, 25 aa, Homo sapiens
  Payload ID: 5104
  Gene Symbol: DUSP16
  Gene Name: Dual specificity phosphatase 16
  ENSP ID: ENSP00000485919
MAHEMIGTQIVTERLVALLESGTEK

SEQ ID NO: 25768 - protein, 143 aa, Homo sapiens; identical to SEQ ID NO: 25763
  Payload ID: 5104
  Gene Symbol: DUSP16
  Gene Name: Dual specificity phosphatase 16
  ENSP ID: ENSP00000487034

SEQ ID NO: 25769 - protein, 6 aa, Homo sapiens
  Payload ID: 5104
  Gene Symbol: DUSP16
  Gene Name: Dual specificity phosphatase 16
  ENSP ID: ENSP00000487493
MAHEMI

SEQ ID NO: 25770 - protein, 665 aa, Homo sapiens; identical to SEQ ID NO: 25764
  Payload ID: 5104
  Gene Symbol: DUSP16
  Gene Name: Dual specificity phosphatase 16
  ENSP ID: ENSP00000487512

SEQ ID NO: 25771 - protein, 188 aa, Homo sapiens
  Payload ID: 5105
  Gene Symbol: DUSP18
  Gene Name: dual specificity phosphatase 18
  Uniprot ID: Q8NEJ0
  ENSP ID: ENSP00000333917
MTAPSCAFPVQFRQPSVSGLSQITKSLYISNGVAANNKLMLSSNQITMVINVSVEVVNTLYEDIQYMQVPVADSPNSRLCDFFDPIADHIHSVEMKQGRTLLHCAAGVSRSAALCLAYLMKYHAMSLLDAHTWTKSCRPIIRPNSGFWEQLIHYEFQLFGKNTVHMVSSPVGMIPDIYEKEVRLMIPL

SEQ ID NO: 25772 - protein, 163 aa, Homo sapiens
  Payload ID: 5105
  Gene Symbol: DUSP18
  Gene Name: dual specificity phosphatase 18
  ENSP ID: ENSP00000340795
MTAPSCAFPVQFRQPSVSGLSQITKSLYISNGVAANNKLMLSSNQITMVINVSVEVVNTLYEDIQYMQVPVADSPNSRLCDFFDPIADHIHSVEMKQGRTLLHCAAGVSRSAALCLAYLMKYHAMSLLDAHTWTKSCRPIIRPNSGFWEQLIHYEFQLFGKNT

SEQ ID NO: 25773 - protein, 188 aa, Homo sapiens; identical to SEQ ID NO: 25771
  Payload ID: 5105
  Gene Symbol: DUSP18
  Gene Name: dual specificity phosphatase 18
  Uniprot ID: Q8NEJ0
  ENSP ID: ENSP00000366291

SEQ ID NO: 25774 - protein, 117 aa, Homo sapiens
  Payload ID: 5105
  Gene Symbol: DUSP18
  Gene Name: dual specificity phosphatase 18
  ENSP ID: ENSP00000384946
MTAPSCAFPVQFRQPSVSGLSQITKSLYISNGVAANNKLMLSSNQITMVINVSVERGDEAGPYFAALCCWCEPLSCPVPRLPHEVPRHVPAGRPHVDQVMPAHHPTQQRLLGAAHPL

SEQ ID NO: 25775 - protein, 188 aa, Homo sapiens; identical to SEQ ID NO: 25771
  Payload ID: 5105
  Gene Symbol: DUSP18
  Gene Name: dual specificity phosphatase 18
  Uniprot ID: Q8NEJ0
  ENSP ID: ENSP00000385463

SEQ ID NO: 25776 - protein, 188 aa, Homo sapiens; identical to SEQ ID NO: 25771
  Payload ID: 5105
  Gene Symbol: DUSP18
  Gene Name: dual specificity phosphatase 18
  Uniprot ID: Q8NEJ0
  ENSP ID: ENSP00000386063

SEQ ID NO: 25777 - protein, 6 aa, Homo sapiens
  Payload ID: 5105
  Gene Symbol: DUSP18
  Gene Name: dual specificity phosphatase 18
  ENSP ID: ENSP00000387680
RLMIPL

SEQ ID NO: 25778 - protein, 11 aa, Homo sapiens
  Payload ID: 5105
  Gene Symbol: DUSP18
  Gene Name: dual specificity phosphatase 18
  ENSP ID: ENSP00000403378
MTAPSCAFPVQ

SEQ ID NO: 25779 - protein, 23 aa, Homo sapiens
  Payload ID: 5105
  Gene Symbol: DUSP18
  Gene Name: dual specificity phosphatase 18
  ENSP ID: ENSP00000414825
  MOD_RES (1)..(1): Any amino acid
XVSSPVGMIPDIYEKEVRLMIPL

SEQ ID NO: 25780 - protein, 166 aa, Homo sapiens
  Payload ID: 5106
  Gene Symbol: DUSP19
  Gene Name: dual specificity phosphatase 19
  Uniprot ID: Q8WTR2
  ENSP ID: ENSP00000343905
MYSLNQEIKAFSRNNLRKQCTRVTTLTGKKIIETWKDARIHVVEEVEPSSGGGCGYVQDLSSDLQVGVIKPWLLLGSQDAAHDLDTLKKNKDGVVLVHCNAGVSRAAAIVIGFLMNSEQTSFTSAFSLVKNARPSICPNSGFMEQLRTYQEGKESNKCDRIQENSS

SEQ ID NO: 25781 - protein, 217 aa, Homo sapiens
  Payload ID: 5106
  Gene Symbol: DUSP19
  Gene Name: dual specificity phosphatase 19
  Uniprot ID: Q8WTR2
  ENSP ID: ENSP00000346160
MYSLNQEIKAFSRNNLRKQCTRVTTLTGKKIIETWKDARIHVVEEVEPSSGGGCGYVQDLSSDLQVGVIKPWLLLGSQDAAHDLDTLKKNKVTHILNVAYGVENAFLSDFTYKSISILDLPETNILSYFPECFEFIEEAKRKDGVVLVHCNAGVSRAAAIVIGFLMNSEQTSFTSAFSLVKNARPSICPNSGFMEQLRTYQEGKESNKCDRIQENSS

SEQ ID NO: 25782 - protein, 314 aa, Homo sapiens
  Payload ID: 5107
  Gene Symbol: DUSP2
  Gene Name: dual specificity phosphatase 2
  Uniprot ID: Q05923
  ENSP ID: ENSP00000288943
MGLEAARELECAALGTLLRDPREAERTLLLDCRPFLAFCRRHVRAARPVPWNALLRRRARGPPAAVLACLLPDRALRTRLVRGELARAVVLDEGSASVAELRPDSPAHVLLAALLHETRAGPTAVYFLRGGFDGFQGCCPDLCSEAPAPALPPTGDKTSRSDSRAPVYDQGGPVEILPYLFLGSCSHSSDLQGLQACGITAVLNVSASCPNHFEGLFRYKSIPVEDNQMVEISAWFQEAIGFIDWVKNSGGRVLVHCQAGISRSATICLAYLMQSRRVRLDEAFDFVKQRRGVISPNFSFMGQLLQFETQVLCH

SEQ ID NO: 25783 - protein, 190 aa, Homo sapiens
  Payload ID: 5108
  Gene Symbol: DUSP21
  Gene Name: dual specificity phosphatase 21
  Uniprot ID: Q9H596
  ENSP ID: ENSP00000343244
MTASASSFSSSQGVQQPSIYSFSQITRSLFLSNGVAANDKLLLSSNRITAIVNASVEVVNVFFEGIQYIKVPVTDARDSRLYDFFDPIADLIHTIDMRQGRTLLHCMAGVSRSASLCLAYLMKYHSMSLLDAHTWTKSRRPIIRPNNGFWEQLINYEFKLFNNNTVRMINSPVGNIPDIYEKDLRMMISM

SEQ ID NO: 25784 - protein, 184 aa, Homo sapiens
  Payload ID: 5109
  Gene Symbol: DUSP22
  Gene Name: dual specificity phosphatase 22
  Uniprot ID: Q9NRW4
  ENSP ID: ENSP00000345281
MGNGMNKILPGLYIGNFKDARDAEQLSKNKVTHILSVHDSARPMLEGVKYLCIPAADSPSQNLTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILAAPGILKFWAFLRRL

SEQ ID NO: 25785 - protein, 205 aa, Homo sapiens
  Payload ID: 5109
  Gene Symbol: DUSP22
  Gene Name: dual specificity phosphatase 22
  Uniprot ID: Q9NRW4
  ENSP ID: ENSP00000397459
MGNGMNKILPGLYIGNFKDARDAEQLSKNKVTHILSVHDSARPMLEGVKYLCIPAADSPSQNLTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILGKYKEQGRTEPQPGARRWSSFPALAPLTYDNYTTET

SEQ ID NO: 25786 - protein, 46 aa, Homo sapiens
  Payload ID: 5109
  Gene Symbol: DUSP22
  Gene Name: dual specificity phosphatase 22
  ENSP ID: ENSP00000474000
MTVTDFGWEDALHTVRAGRSCANPNVGFQRQLQEFEKHEVHQVSSS

SEQ ID NO: 25787 - protein, 75 aa, Homo sapiens
  Payload ID: 5109
  Gene Symbol: DUSP22
  Gene Name: dual specificity phosphatase 22
  ENSP ID: ENSP00000474082
MLEGVKYLCIPAADSPSQNLTRHFKESIKFIHECRLRGESCLVHCLAGVSRSVTLVIAYIMTVTDFGWEDALHTV

SEQ ID NO: 25788 - protein, 54 aa, Homo sapiens
  Payload ID: 5109
  Gene Symbol: DUSP22
  Gene Name: dual specificity phosphatase 22
  ENSP ID: ENSP00000474330
MGNGMNKILPGLYIGNFKDARDAEQLSKNKVTHILSVHDSARPMLEDKTFQRKY

SEQ ID NO: 25789 - protein, 18 aa, Homo sapiens
  Payload ID: 5109
  Gene Symbol: DUSP22
  Gene Name: dual specificity phosphatase 22
  ENSP ID: ENSP00000474450
MPCTPCVLGDPVPTPTWA

SEQ ID NO: 25790 - protein, 102 aa, Homo sapiens
  Payload ID: 5109
  Gene Symbol: DUSP22
  Gene Name: dual specificity phosphatase 22
  ENSP ID: ENSP00000474505
MTVTDFGWEDALHTVRAGRSCANPNVGFQRQLQEFEKHEVHQYRQWLKEEYGESPLQDAEEAKNILGKYKEQGRTEPQPGARRWSSFPALAPLTYDNYTTET

SEQ ID NO: 25791 - protein, 102 aa, Homo sapiens; identical to SEQ ID NO: 25790
  Payload ID: 5109
  Gene Symbol: DUSP22
  Gene Name: dual specificity phosphatase 22
  ENSP ID: ENSP00000474646

SEQ ID NO: 25792 - protein, 102 aa, Homo sapiens; identical to SEQ ID NO: 25790
  Payload ID: 5109
  Gene Symbol: DUSP22
  Gene Name: dual specificity phosphatase 22
  ENSP ID: ENSP00000474827

SEQ ID NO: 25793 - protein, 46 aa, Homo sapiens; identical to SEQ ID NO: 25786
  Payload ID: 5109
  Gene Symbol: DUSP22
  Gene Name: dual specificity phosphatase 22
  ENSP ID: ENSP00000475061

SEQ ID NO: 25794 - protein, 54 aa, Homo sapiens; identical to SEQ ID NO: 25788
  Payload ID: 5109
  Gene Symbol: DUSP22
  Gene Name: dual specificity phosphatase 22
  ENSP ID: ENSP00000475106

SEQ ID NO: 25795 - protein, 150 aa, Homo sapiens
  Payload ID: 5110
  Gene Symbol: DUSP23
  Gene Name: dual specificity phosphatase 23
  Uniprot ID: Q9BVJ7
  ENSP ID: ENSP00000357087
MGVQPPNFSWVLPGRLAGLALPRLPAHYQFLLDLGVRHLVSLTERGPPHSDSCPGLTLHRLRIPDFCPPAPDQIDRFVQIVDEANARGEAVGVHCALGFGRTGTMLACYLVKERGLAAGDAIAEIRRLRPGSIETYEQEKAVFQFYQRTK

SEQ ID NO: 25796 - protein, 150 aa, Homo sapiens; identical to SEQ ID NO: 25795
  Payload ID: 5110
  Gene Symbol: DUSP23
  Gene Name: dual specificity phosphatase 23
  Uniprot ID: Q9BVJ7
  ENSP ID: ENSP00000357088

SEQ ID NO: 25797 - protein, 150 aa, Homo sapiens; identical to SEQ ID NO: 25795
  Payload ID: 5110
  Gene Symbol: DUSP23
  Gene Name: dual specificity phosphatase 23
  Uniprot ID: Q9BVJ7
  ENSP ID: ENSP00000357089

SEQ ID NO: 25798 - protein, 211 aa, Homo sapiens
  Payload ID: 5111
  Gene Symbol: DUSP26
  Gene Name: dual specificity phosphatase 26 (putative)
  Uniprot ID: Q9BV47
  ENSP ID: ENSP00000256261
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMSIHFQTAADFIHRALSQPGGKILVHCAVGVSRSATLVLAYLMLYHHLTLVEAIKKVKDHRGIIPNRGFLRQLLALDRRLRQGLEA

SEQ ID NO: 25799 - protein, 211 aa, Homo sapiens; identical to SEQ ID NO: 25798
  Payload ID: 5111
  Gene Symbol: DUSP26
  Gene Name: dual specificity phosphatase 26 (putative)
  Uniprot ID: Q9BV47
  ENSP ID: ENSP00000429176

SEQ ID NO: 25800 - protein, 145 aa, Homo sapiens
  Payload ID: 5111
  Gene Symbol: DUSP26
  Gene Name: dual specificity phosphatase 26 (putative)
  ENSP ID: ENSP00000430922
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMSIHFQTAADFIHRALSQPG

SEQ ID NO: 25801 - protein, 1158 aa, Homo sapiens
  Payload ID: 5112
  Gene Symbol: DUSP27
  Gene Name: dual specificity phosphatase 27 (putative)
  Uniprot ID: Q5VZP5
  ENSP ID: ENSP00000271385
MATRKDTEEEQVVPSEEDEANVRAVQAHYLRSPSPSQYSMVSDAETESIFMEPIHLSSAIAAKQIINEELKPPGVRADAECPGMLESAEQLLVEDLYNRVREKMDDTSLYNTPCVLDLQRALVQDRQEAPWNEVDEVWPNVFIAEKSVAVNKGRLKRLGITHILNAAHGTGVYTGPEFYTGLEIQYLGVEVDDFPEVDISQHFRKASEFLDEALLTYRGKVLVSSEMGISRSAVLVVAYLMIFHNMAILEALMTVRKKRAIYPNEGFLKQLRELNEKLMEEREEDYGREGGSAEAEEGEGTGSMLGARVHALTVEEEDDSASHLSGSSLGKATQASKPLTLIDEEEEEKLYEQWKKGQGLLSDKVPQDGGGWRSASSGQGGEELEDEDVERIIQEWQSRNERYQAEGYRRWGREEEKEEESDAGSSVGRRRRTLSESSAWESVSSHDIWVLKQQLELNRPDHGRRRRADSMSSESTWDAWNERLLEIEKEASRRYHAKSKREEAADRSSEAGSRVREDDEDSVGSEASSFYNFCSRNKDKLTALERWKIKRIQFGFHKKDLGAGDSSGEPGAEEAVGEKNPSDVSLTAYQAWKLKHQKKVGSENKEEVVELSKGEDSALAKKRQRRLELLERSRQTLEESQSMASWEADSSTASGSIPLSAFWSADPSVSADGDTTSVLSTQSHRSHLSQAASNIAGCSTSNPTTPLPNLPVGPGDTISIASIQNWIANVVSETLAQKQNEMLLLSRSPSVASMKAVPAASCLGDDQVSMLSGHSSSSLGGCLLPQSQARPSSDMQSVLSCNTTLSSPAESCRSKVRGTSKPIFSLFADNVDLKELGRKEKEMQMELREKMSEYKMEKLASDNKRSSLFKKKKVKEDEDDGVGDGDEDTDSAIGSFRYSSRSNSQKPETDTCSSLAVCDHYASGSRVGKEMDSSINKWLSGLRTEEKPPFQSDWSGSSRGKYTRSSLLRETESKSSSYKFSKSQSEEQDTSSYHEANGNSVRSTSRFSSSSTREGREMHKFSRSTYNETSSSREESPEPYFFRRTPESSEREESPEPQRPNWARSRDWEDVEESSKSDFSEFGAKRKFTQSFMRSEEEGEKERTENREEGRFASGRRSQYRRSTDREEEEEMDDEAIIAAWRRRQEETRTKLQKRRED

SEQ ID NO: 25802 - protein, 1158 aa, Homo sapiens; identical to SEQ ID NO: 25801
  Payload ID: 5112
  Gene Symbol: DUSP27
  Gene Name: dual specificity phosphatase 27 (putative)
  Uniprot ID: Q5VZP5
  ENSP ID: ENSP00000354483

SEQ ID NO: 25803 - protein, 1158 aa, Homo sapiens; identical to SEQ ID NO: 25801
  Payload ID: 5112
  Gene Symbol: DUSP27
  Gene Name: dual specificity phosphatase 27 (putative)
  Uniprot ID: Q5VZP5
  ENSP ID: ENSP00000404874

SEQ ID NO: 25804 - protein, 176 aa, Homo sapiens
  Payload ID: 5113
  Gene Symbol: DUSP28
  Gene Name: dual specificity phosphatase 28
  Uniprot ID: Q4G0W2
  ENSP ID: ENSP00000344235
MGPAEAGRRGAASPVPPPLVRVAPSLFLGSARAAGAEEQLARAGVTLCVNVSRQQPGPRAPGVAELRVPVFDDPAEDLLAHLEPTCAAMEAAVRAGGACLVYCKNGRSRSAAVCTAYLMRHRGLSLAKAFQMVKSARPVAEPNPGFWSQLQKYEEALQAQSCLQGEPPALGLGPEA

SEQ ID NO: 25805 - protein, 176 aa, Homo sapiens; identical to SEQ ID NO: 25804
  Payload ID: 5113
  Gene Symbol: DUSP28
  Gene Name: dual specificity phosphatase 28
  Uniprot ID: Q4G0W2
  ENSP ID: ENSP00000385885

SEQ ID NO: 25806 - protein, 141 aa, Homo sapiens
  Payload ID: 5113
  Gene Symbol: DUSP28
  Gene Name: dual specificity phosphatase 28
  ENSP ID: ENSP00000403899
  MOD_RES (1)..(1): Any amino acid
XEEQLARAGVTLCVNVSRQQPGPRAPGVAELRVPVFDDPAEDLLAHLEPTCAAMEAAVRAGGACLVYCKNGRSRSAAVCTAYLMRHRGLSLAKAFQMVKSARPVAEPNPGFWSQLQKYEEALQAQSCLQGEPPALGLGPEA

SEQ ID NO: 25807 - protein, 185 aa, Homo sapiens
  Payload ID: 5114
  Gene Symbol: DUSP3
  Gene Name: dual specificity phosphatase 3
  Uniprot ID: P51452
  ENSP ID: ENSP00000226004
MSGSFELSVQDLNDLLSDGSGCYSLPSQPCNEVTPRIYVGNASVAQDIPKLQKLGITHVLNAAEGRSFMHVNTNANFYKDSGITYLGIKANDTQEFNLSAYFERAADFIDQALAQKNGRVLVHCREGYSRSPTLVIAYLMMRQKMDVKSALSIVRQNREIGPNDGFLAQLCQLNDRLAKEGKLKP

SEQ ID NO: 25808 - protein, 112 aa, Homo sapiens
  Payload ID: 5114
  Gene Symbol: DUSP3
  Gene Name: dual specificity phosphatase 3
  ENSP ID: ENSP00000466069
  MOD_RES (1)..(1): Any amino acid
XAYFERAADFIDQALAQKNDGVSLLLPRLKSNGAILAHRNLHLPGRVLVHCREGYSRSPTLVIAYLMMRQKMDVKSALSIVRQNREIGPNDGFLAQLCQLNDRLAKEGKLKP

SEQ ID NO: 25809 - protein, 45 aa, Homo sapiens
  Payload ID: 5114
  Gene Symbol: DUSP3
  Gene Name: dual specificity phosphatase 3
  ENSP ID: ENSP00000467424
MSGSFELSVQDLNDLLSDGSGCYSLPSQPCNEVTPRIYVGNAKNV

SEQ ID NO: 25810 - protein, 132 aa, Homo sapiens
  Payload ID: 5114
  Gene Symbol: DUSP3
  Gene Name: dual specificity phosphatase 3
  ENSP ID: ENSP00000468604
  MOD_RES (1)..(1): Any amino acid
XSVAQDIPKLQKLGITHVLNAAEGRSFMHVNTNANFYKDSGITYLGIKANDTQEFNLSAYFERAADFIDQALAQKNDGVSLLLPRLKSNGAILAHRNLHLPGSSDSPASASRLSLPSSWDYRPGARPLPGRL

SEQ ID NO: 25811 - protein, 394 aa, Homo sapiens
  Payload ID: 5115
  Gene Symbol: DUSP4
  Gene Name: dual specificity phosphatase 4
  Uniprot ID: Q13115
  ENSP ID: ENSP00000240100
MVTMEELREMDCSVLKRLMNRDENGGGAGGSGSHGTLGLPSGGKCLLLDCRPFLAHSAGYILGSVNVRCNTIVRRRAKGSVSLEQILPAEEEVRARLRSGLYSAVIVYDERSPRAESLREDSTVSLVVQALRRNAERTDICLLKGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 25812 - protein, 303 aa, Homo sapiens
  Payload ID: 5115
  Gene Symbol: DUSP4
  Gene Name: dual specificity phosphatase 4
  Uniprot ID: Q13115
  ENSP ID: ENSP00000240101
MGRKVHSNGSQFAEHSRSPRRTGRDCKPVRAPSMALGVSQLAGRSRCLCSESQGGYERFSSEYPEFCSKTKALAAIPPPVPPSATEPLDLGCSSCGTPLHDQGGPVEILPFLYLGSAYHAARRDMLDALGITALLNVSSDCPNHFEGHYQYKCIPVEDNHKADISSWFMEAIEYIDAVKDCRGRVLVHCQAGISRSATICLAYLMMKKRVRLEEAFEFVKQRRSIISPNFSFMGQLLQFESQVLATSCAAEAASPSGPLRERGKTPATPTSQFVFSFPVSVGVHSAPSSLPYLHSPITTSPSC

SEQ ID NO: 25813 - protein, 384 aa, Homo sapiens
  Payload ID: 5116
  Gene Symbol: DUSP5
  Gene Name: dual specificity phosphatase 5
  Uniprot ID: Q16690
  ENSP ID: ENSP00000358596
MKVTSLDGRQLRKMLRKEAAARCVVLDCRPYLAFAASNVRGSLNVNLNSVVLRRARGGAVSARYVLPDEAARARLLQEGGGGVAAVVVLDQGSRHWQKLREESAARVVLTSLLACLPAGPRVYFLKGGYETFYSEYPECCVDVKPISQEKIESERALISQCGKPVVNVSYRPAYDQGGPVEILPFLYLGSAYHASKCEFLANLHITALLNVSRRTSEACATHLHYKWIPVEDSHTADISSHFQEAIDFIDCVREKGGKVLVHCEAGISRSPTICMAYLMKTKQFRLKEAFDYIKQRRSMVSPNFGFMGQLLQYESEILPSTPNPQPPSCQGEAAGSSLIGHLQTLSPDMQGAYCTFPASVLAPVPTHSTVSELSRSPVATATSC

SEQ ID NO: 25814 - protein, 381 aa, Homo sapiens
  Payload ID: 5117
  Gene Symbol: DUSP6
  Gene Name: dual specificity phosphatase 6
  Uniprot ID: Q16828
  ENSP ID: ENSP00000279488
MIDTLRPVPFASEMAISKTVAWLNEQLELGNERLLLMDCRPQELYESSHIESAINVAIPGIMLRRLQKGNLPVRALFTRGEDRDRFTRRCGTDTVVLYDESSSDWNENTGGESVLGLLLKKLKDEGCRAFYLEGGFSKFQAEFSLHCETNLDGSCSSSSPPLPVLGLGGLRISSDSSSDIESDLDRDPNSATDSDGSPLSNSQPSFPVEILPFLYLGCAKDSTNLDVLEEFGIKYILNVTPNLPNLFENAGEFKYKQIPISDHWSQNLSQFFPEAISFIDEARGKNCGVLVHCLAGISRSVTVTVAYLMQKLNLSMNDAYDIVKMKKSNISPNFNFMGQLLDFERTLGLSSPCDNRVPAQQLYFTTPSNQNVYQVDSLQST

SEQ ID NO: 25815 - protein, 235 aa, Homo sapiens
  Payload ID: 5117
  Gene Symbol: DUSP6
  Gene Name: dual specificity phosphatase 6
  Uniprot ID: Q16828
  ENSP ID: ENSP00000307835
MIDTLRPVPFASEMAISKTVAWLNEQLELGNERLLLMDCRPQELYESSHIESAINVAIPGIMLRRLQKGNLPVRALFTRGEDRDRFTRRCGTDTVVLYDESSSDWNENTGGESVLGLLLKKLKDEGCRAFYLEDEARGKNCGVLVHCLAGISRSVTVTVAYLMQKLNLSMNDAYDIVKMKKSNISPNFNFMGQLLDFERTLGLSSPCDNRVPAQQLYFTTPSNQNVYQVDSLQST

SEQ ID NO: 25816 - protein, 117 aa, Homo sapiens
  Payload ID: 5117
  Gene Symbol: DUSP6
  Gene Name: dual specificity phosphatase 6
  ENSP ID: ENSP00000446858
MIDTLRPVPFASEMAISKTVAWLNEQLELGNERLLLMDCRPQELYESSHIESAINVAIPGIMLRRLQKGNLPVRALFTRGEDRDRFTRRCGTDTVVLYDESSSDWNENTGGESVLGL

SEQ ID NO: 25817 - protein, 256 aa, Homo sapiens
  Payload ID: 5117
  Gene Symbol: DUSP6
  Gene Name: dual specificity phosphatase 6
  ENSP ID: ENSP00000449838
MIAFLVLAGGFSKFQAEFSLHCETNLDGSCSSSSPPLPVLGLGGLRISSDSSSDIESDLDRDPNSATDSDGSPLSNSQPSFPVEILPFLYLGCAKDSTNLDVLEEFGIKYILNVTPNLPNLFENAGEFKYKQIPISDHWSQNLSQFFPEAISFIDEARGKNCGVLVHCLAGISRSVTVTVAYLMQKLNLSMNDAYDIVKMKKSNISPNFNFMGQLLDFERTLGLSSPCDNRVPAQQLYFTTPSNQNVYQVDSLQST

SEQ ID NO: 25818 - protein, 419 aa, Homo sapiens
  Payload ID: 5118
  Gene Symbol: DUSP7
  Gene Name: dual specificity phosphatase 7
  Uniprot ID: Q16829
  ENSP ID: ENSP00000417183
MKNQLRGPPARAHMSTSGAAAAGGTRAGSEPGAGSGSGAGTGAGAATGAGAMPCKSAEWLQEELEARGGASLLLLDCRPHELFESSHIETAINLAIPGLMLRRLRKGNLPIRSIIPNHADKERFATRCKAATVLLYDEATAEWQPEPGAPASVLGLLLQKLRDDGCQAYYLQGGFNKFQTEYSEHCETNVDSSSSPSSSPPTSVLGLGGLRISSDCSDGESDRELPSSATESDGSPVPSSQPAFPVQILPYLYLGCAKDSTNLDVLGKYGIKYILNVTPNLPNAFEHGGEFTYKQIPISDHWSQNLSQFFPEAISFIDEARSKKCGVLVHCLAGISRSVTVTVAYLMQKMNLSLNDAYDFVKRKKSNISPNFNFMGQLLDFERTLGLSSPCDNHASSEQLYFSTPTNHNLFPLNTLEST

SEQ ID NO: 25819 - protein, 275 aa, Homo sapiens
  Payload ID: 5118
  Gene Symbol: DUSP7
  Gene Name: dual specificity phosphatase 7
  ENSP ID: ENSP00000418566
GGASLLLLDCRPHELFESSHIETAINLAIPGLMLRRLRKGNLPIRSIIPNHADKERFATRCKAATVLLYDEATAEWQPEPGAPASVLGLLLQKLRDDGCQAYYLQGGFNKFQTEYSEHCETNVDSSSSPSSSPPTSVLGLGGLRISSDCSDGESDRELPSSATESDGSPVPSSQPAFPVQILPYLYLGCAKDSTNLDVLGKYGIKYILNVTPNLPNAFEHGGEFTYKQIPISDHWSQNLSQFFPEAISFIGRCCVLGRGVWVHQGVCRTLGGAPA

SEQ ID NO: 25820 - protein, 625 aa, Homo sapiens
  Payload ID: 5119
  Gene Symbol: DUSP8
  Gene Name: dual specificity phosphatase 8
  Uniprot ID: Q13202
  ENSP ID: ENSP00000329539
MAGDRLPRKVMDAKKLASLLRGGPGGPLVIDSRSFVEYNSWHVLSSVNICCSKLVKRRLQQGKVTIAELIQPAARSQVEATEPQDVVVYDQSTRDASVLAADSFLSILLSKLDGCFDSVAILTGGFATFSSCFPGLCEGKPAALLPMSLSQPCLPVPSVGLTRILPHLYLGSQKDVLNKDLMTQNGISYVLNASNSCPKPDFICESRFMRVPINDNYCEKLLPWLDKSIEFIDKAKLSSCQVIVHCLAGISRSATIAIAYIMKTMGMSSDDAYRFVKDRRPSISPNFNFLGQLLEYERSLKLLAALQGDPGTPSGTPEPPPSPAAGAPLPRLPPPTSESAATGNAAAREGGLSAGGEPPAPPTPPATSALQQGLRGLHLSSDRLQDTNRLKRSFSLDIKSAYAPSRRPDGPGPPDPGEAPKLCKLDSPSGAALGLSSPSPDSPDAAPEARPRPRRRPRPPAGSPARSPAHSLGLNFGDAARQTPRHGLSALSAPGLPGPGQPAGPGAWAPPLDSPGTPSPDGPWCFSPEGAQGAGGVLFAPFGRAGAPGPGGGSDLRRREAARAEPRDARTGWPEEPAPETQFKRRSCQMEFEEGMVEGRARGEELAALGKQASFSGSVEVIEVS

SEQ ID NO: 25821 - protein, 625 aa, Homo sapiens; identical to SEQ ID NO: 25820
  Payload ID: 5119
  Gene Symbol: DUSP8
  Gene Name: dual specificity phosphatase 8
  Uniprot ID: Q13202
  ENSP ID: ENSP00000380530

SEQ ID NO: 25822 - protein, 625 aa, Homo sapiens; identical to SEQ ID NO: 25820
  Payload ID: 5119
  Gene Symbol: DUSP8
  Gene Name: dual specificity phosphatase 8
  Uniprot ID: Q13202
  ENSP ID: ENSP00000479946

SEQ ID NO: 25823 - protein, 625 aa, Homo sapiens; identical to SEQ ID NO: 25820
  Payload ID: 5119
  Gene Symbol: DUSP8
  Gene Name: dual specificity phosphatase 8
  Uniprot ID: Q13202
  ENSP ID: ENSP00000481775

SEQ ID NO: 25824 - protein, 625 aa, Homo sapiens; identical to SEQ ID NO: 25820
  Payload ID: 5119
  Gene Symbol: DUSP8
  Gene Name: dual specificity phosphatase 8
  Uniprot ID: Q13202
  ENSP ID: ENSP00000487017

SEQ ID NO: 25825 - protein, 625 aa, Homo sapiens; identical to SEQ ID NO: 25820
  Payload ID: 5119
  Gene Symbol: DUSP8
  Gene Name: dual specificity phosphatase 8
  Uniprot ID: Q13202
  ENSP ID: ENSP00000487093

SEQ ID NO: 25826 - protein, 384 aa, Homo sapiens
  Payload ID: 5120
  Gene Symbol: DUSP9
  Gene Name: dual specificity phosphatase 9
  Uniprot ID: Q99956
  ENSP ID: ENSP00000345853
MEGLGRSCLWLRRELSPPRPRLLLLDCRSRELYESARIGGALSVALPALLLRRLRRGSLSVRALLPGPPLQPPPPAPVLLYDQGGGRRRRGEAEAEAEEWEAESVLGTLLQKLREEGYLAYYLQGGFSRFQAECPHLCETSLAGRAGSSMAPVPGPVPVVGLGSLCLGSDCSDAESEADRDSMSCGLDSEGATPPPVGLRASFPVQILPNLYLGSARDSANLESLAKLGIRYILNVTPNLPNFFEKNGDFHYKQIPISDHWSQNLSRFFPEAIEFIDEALSQNCGVLVHCLAGVSRSVTVTVAYLMQKLHLSLNDAYDLVKRKKSNISPNFNFMGQLLDFERSLRLEERHSQEQGSGGQASAASNPPSFFTTPTSDGAFELAPT

SEQ ID NO: 25827 - protein, 384 aa, Homo sapiens; identical to SEQ ID NO: 25826
  Payload ID: 5120
  Gene Symbol: DUSP9
  Gene Name: dual specificity phosphatase 9
  Uniprot ID: Q99956
  ENSP ID: ENSP00000359186

SEQ ID NO: 25828 - protein, 220 aa, Homo sapiens
  Payload ID: 5121
  Gene Symbol: DUPD1
  Gene Name: dual specificity phosphatase and pro isomerase domain containing 1
  Uniprot ID: Q68J44
  ENSP ID: ENSP00000340609
MTSGEVKTSLKNAYSSAKRLSPKMEEEGEEEDYCTPGAFELERLFWKGSPQYTHVNEVWPKLYIGDEATALDRYRLQKAGFTHVLNAAHGRWNVDTGPDYYRDMDIQYHGVEADDLPTFDLSVFFYPAAAFIDRALSDDHSKILVHCVMGRSRSATLVLAYLMIHKDMTLVDAIQQVAKNRCVLPNRGFLKQLRELDKQLVQQRRRSQRQDGEEEDGREL

SEQ ID NO: 25829 - protein, 220 aa, Homo sapiens; identical to SEQ ID NO: 25828
  Payload ID: 5121
  Gene Symbol: DUPD1
  Gene Name: Dual specificity phosphatase and pro isomerase domain containing 1
  ENSP ID: ENSP00000487404

SEQ ID NO: 25830 - protein, 754 aa, Homo sapiens
  Payload ID: 5122
  Gene Symbol: DYRK1A
  Gene Name: dual-specificity tyrosine-(Y)-phosphorylation regulated kinase 1A
  Uniprot ID: Q13627
  ENSP ID: ENSP00000340373
MHTGGETSACKPSSVRLAPSFSFHAAGLQMAGQMPHSHQYSDRRQPNISDQQVSALSYSDQIQQPLTNQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVRQQFPAPLGWSGTEAPTQVTVETHPVQETTFHVAPQQNALHHHHGNSSHHHHHHHHHHHHHGQQALGNRTRPRVYNSPTNSSSTQDSMEVGHSHHSMTSLSSSTTSSSTSSSSTGNQGNQAYQNRPVAANTLDFGQNGAMDVNLTVYSNPRQETGIAGHPTYQFSANTGPAHYMTEGHLTMRQGADREESPMTGVCVQQSPVASS

SEQ ID NO: 25831 - protein, 584 aa, Homo sapiens
  Payload ID: 5122
  Gene Symbol: DYRK1A
  Gene Name: dual-specificity tyrosine-(Y)-phosphorylation regulated kinase 1A
  Uniprot ID: Q13627
  ENSP ID: ENSP00000342690
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVSSHVVHLLVSPAILRWSSTGCQVPLE

SEQ ID NO: 25832 - protein, 529 aa, Homo sapiens
  Payload ID: 5122
  Gene Symbol: DYRK1A
  Gene Name: dual-specificity tyrosine-(Y)-phosphorylation regulated kinase 1A
  Uniprot ID: Q13627
  ENSP ID: ENSP00000381929
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGASAISCSSWLVRH

SEQ ID NO: 25833 - protein, 763 aa, Homo sapiens
  Payload ID: 5122
  Gene Symbol: DYRK1A
  Gene Name: dual-specificity tyrosine-(Y)-phosphorylation regulated kinase 1A
  Uniprot ID: Q13627
  ENSP ID: ENSP00000381932
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFRGVSLNLTRKFAQQMCTALLFLATPELSIIHCDLKPENILLCNPKRSAIKIVDFGSSCQLGQRIYQYIQSRFYRSPEVLLGMPYDLAIDMWSLGCILVEMHTGEPLFSGANEVDQMNKIVEVLGIPPAHILDQAPKARKFFEKLPDGTWNLKKTKDGKREYKPPGTRKLHNILGVETGGPGGRRAGESGHTVADYLKFKDLILRMLDYDPKTRIQPYYALQHSFFKKTADEGTNTSNSVSTSPAMEQSQSSGTTSSTSSSSGGSSGTSNSGRARSDPTHQHRHSGGHFTAAVQAMDCETHSPQVRQQFPAPLGWSGTEAPTQVTVETHPVQETTFHVAPQQNALHHHHGNSSHHHHHHHHHHHHHGQQALGNRTRPRVYNSPTNSSSTQDSMEVGHSHHSMTSLSSSTTSSSTSSSSTGNQGNQAYQNRPVAANTLDFGQNGAMDVNLTVYSNPRQETGIAGHPTYQFSANTGPAHYMTEGHLTMRQGADREESPMTGVCVQQSPVASS

SEQ ID NO: 25834 - protein, 46 aa, Homo sapiens
  Payload ID: 5122
  Gene Symbol: DYRK1A
  Gene Name: dual-specificity tyrosine-(Y)-phosphorylation regulated kinase 1A
  ENSP ID: ENSP00000398483
MHTGGETSACKPSSVRLAPSFSFHAAGLQMAGQMPHSHQYSDRRQP

SEQ ID NO: 25835 - protein, 131 aa, Homo sapiens
  Payload ID: 5122
  Gene Symbol: DYRK1A
  Gene Name: dual-specificity tyrosine-(Y)-phosphorylation regulated kinase 1A
  ENSP ID: ENSP00000412269
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKK

SEQ ID NO: 25836 - protein, 601 aa, Homo sapiens
  Payload ID: 5123
  Gene Symbol: DYRK1B
  Gene Name: dual-specificity tyrosine-(Y)-phosphorylation regulated kinase 1B
  Uniprot ID: Q9Y463
  ENSP ID: ENSP00000221803
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDYQGPGTRRLQEDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 25837 - protein, 629 aa, Homo sapiens
  Payload ID: 5123
  Gene Symbol: DYRK1B
  Gene Name: dual-specificity tyrosine-(Y)-phosphorylation regulated kinase 1B
  Uniprot ID: Q9Y463
  ENSP ID: ENSP00000312789
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDYQGPGTRRLQEVLGVQTGGPGGRRAGEPGHSPADYLRFQDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 25838 - protein, 589 aa, Homo sapiens
  Payload ID: 5123
  Gene Symbol: DYRK1B
  Gene Name: dual-specificity tyrosine-(Y)-phosphorylation regulated kinase 1B
  Uniprot ID: Q9Y463
  ENSP ID: ENSP00000403182
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 25839 - protein, 629 aa, Homo sapiens; identical to SEQ ID NO: 25837
  Payload ID: 5123
  Gene Symbol: DYRK1B
  Gene Name: dual-specificity tyrosine-(Y)-phosphorylation regulated kinase 1B
  Uniprot ID: Q9Y463
  ENSP ID: ENSP00000469863

SEQ ID NO: 25840 - protein, 172 aa, Homo sapiens
  Payload ID: 5123
  Gene Symbol: DYRK1B
  Gene Name: dual-specificity tyrosine-(Y)-phosphorylation regulated kinase 1B
  ENSP ID: ENSP00000471609
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYY

SEQ ID NO: 25841 - protein, 137 aa, Homo sapiens
  Payload ID: 5123
  Gene Symbol: DYRK1B
  Gene Name: dual-specificity tyrosine-(Y)-phosphorylation regulated kinase 1B
  ENSP ID: ENSP00000472861
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVWDTPHHPDPRPH

SEQ ID NO: 25842 - protein, 601 aa, Homo sapiens; identical to SEQ ID NO: 25836
  Payload ID: 5123
  Gene Symbol: DYRK1B
  Gene Name: dual-specificity tyrosine-(Y)-phosphorylation regulated kinase 1B
  Uniprot ID: Q9Y463
  ENSP ID: ENSP00000472941

SEQ ID NO: 25843 - protein, 629 aa, Homo sapiens; identical to SEQ ID NO: 25837
  Payload ID: 5123
  Gene Symbol: DYRK1B
  Gene Name: dual-specificity tyrosine-(Y)-phosphorylation regulated kinase 1B
  Uniprot ID: Q9Y463
  ENSP ID: ENSP00000485915

SEQ ID NO: 25844 - protein, 137 aa, Homo sapiens; identical to SEQ ID NO: 25841
  Payload ID: 5123
  Gene Symbol: DYRK1B
  Gene Name: dual-specificity tyrosine-(Y)-phosphorylation regulated kinase 1B
  ENSP ID: ENSP00000486264

SEQ ID NO: 25845 - protein, 629 aa, Homo sapiens; identical to SEQ ID NO: 25837
  Payload ID: 5123
  Gene Symbol: DYRK1B
  Gene Name: dual-specificity tyrosine-(Y)-phosphorylation regulated kinase 1B
  Uniprot ID: Q9Y463
  ENSP ID: ENSP00000486377

SEQ ID NO: 25846 - protein, 601 aa, Homo sapiens; identical to SEQ ID NO: 25836
  Payload ID: 5123
  Gene Symbol: DYRK1B
  Gene Name: dual-specificity tyrosine-(Y)-phosphorylation regulated kinase 1B
  Uniprot ID: Q9Y463
  ENSP ID: ENSP00000486839

SEQ ID NO: 25847 - protein, 172 aa, Homo sapiens; identical to SEQ ID NO: 25840
  Payload ID: 5123
  Gene Symbol: DYRK1B
  Gene Name: dual-specificity tyrosine-(Y)-phosphorylation regulated kinase 1B
  ENSP ID: ENSP00000486913

SEQ ID NO: 25848 - protein, 601 aa, Homo sapiens; identical to SEQ ID NO: 25836
  Payload ID: 5123
  Gene Symbol: DYRK1B
  Gene Name: dual-specificity tyrosine-(Y)-phosphorylation regulated kinase 1B
  Uniprot ID: Q9Y463
  ENSP ID: ENSP00000487313

SEQ ID NO: 25849 - protein, 589 aa, Homo sapiens; identical to SEQ ID NO: 25838
  Payload ID: 5123
  Gene Symbol: DYRK1B
  Gene Name: dual-specificity tyrosine-(Y)-phosphorylation regulated kinase 1B
  Uniprot ID: Q9Y463
  ENSP ID: ENSP00000487539

SEQ ID NO: 25850 - protein, 93 aa, Homo sapiens
  Payload ID: 5124
  Gene Symbol: DYRK2
  Gene Name: dual-specificity tyrosine-(Y)-phosphorylation regulated kinase 2
  ENSP ID: ENSP00000324733
MNDHLHVGSHAHGQIQVQQLFEDNSNKRTVLTTQPNGLTTVGKTGLPVVPERQLDSIHRRQGSSTSLKSMEGMGKVKATPMTPEQAMKQYMQK

SEQ ID NO: 25851 - protein, 601 aa, Homo sapiens
  Payload ID: 5124
  Gene Symbol: DYRK2
  Gene Name: dual-specificity tyrosine-(Y)-phosphorylation regulated kinase 2
  Uniprot ID: Q92630
  ENSP ID: ENSP00000342105
MLTRKPSAAAPAAYPTGRGGDSAVRQLQASPGLGAGATRSGVGTGPPSPIALPPLRASNAAAAAHTIGGSKHTMNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAKKRQGMTGGPNNGGYDDDQGSYVQVPHDHVAYRYEVLKVIGKGSFGQVVKAYDHKVHQHVALKMVRNEKRFHRQAAEEIRILEHLRKQDKDNTMNVIHMLENFTFRNHICMTFELLSMNLYELIKKNKFQGFSLPLVRKFAHSILQCLDALHKNRIIHCDLKPENILLKQQGRSGIKVIDFGSSCYEHQRVYTYIQSRFYRAPEVILGARYGMPIDMWSLGCILAELLTGYPLLPGEDEGDQLACMIELLGMPSQKLLDASKRAKNFVSSKGYPRYCTVTTLSDGSVVLNGGRSRRGKLRGPPESREWGNALKGCDDPLFLDFLKQCLEWDPAVRMTPGQALRHPWLRRRLPKPPTGEKTSVKRITESTGAITSISKLPPPSSSASKLRTNLAQMTDANGNIQQRTVLPKLVS

SEQ ID NO: 25852 - protein, 528 aa, Homo sapiens
  Payload ID: 5124
  Gene Symbol: DYRK2
  Gene Name: dual-specificity tyrosine-(Y)-phosphorylation regulated kinase 2
  Uniprot ID: Q92630
  ENSP ID: ENSP00000377186
MNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAKKRQGMTGGPNNGGYDDDQGSYVQVPHDHVAYRYEVLKVIGKGSFGQVVKAYDHKVHQHVALKMVRNEKRFHRQAAEEIRILEHLRKQDKDNTMNVIHMLENFTFRNHICMTFELLSMNLYELIKKNKFQGFSLPLVRKFAHSILQCLDALHKNRIIHCDLKPENILLKQQGRSGIKVIDFGSSCYEHQRVYTYIQSRFYRAPEVILGARYGMPIDMWSLGCILAELLTGYPLLPGEDEGDQLACMIELLGMPSQKLLDASKRAKNFVSSKGYPRYCTVTTLSDGSVVLNGGRSRRGKLRGPPESREWGNALKGCDDPLFLDFLKQCLEWDPAVRMTPGQALRHPWLRRRLPKPPTGEKTSVKRITESTGAITSISKLPPPSSSASKLRTNLAQMTDANGNIQQRTVLPKLVS

SEQ ID NO: 25853 - protein, 156 aa, Homo sapiens
  Payload ID: 5124
  Gene Symbol: DYRK2
  Gene Name: dual-specificity tyrosine-(Y)-phosphorylation regulated kinase 2
  ENSP ID: ENSP00000440839
MNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAKKRQGMTGGPNNGGYDDDQGSYVQVPHDHVAYRYEVLKVIG

SEQ ID NO: 25854 - protein, 167 aa, Homo sapiens
  Payload ID: 5124
  Gene Symbol: DYRK2
  Gene Name: dual-specificity tyrosine-(Y)-phosphorylation regulated kinase 2
  ENSP ID: ENSP00000443314
MRMCFSVLLIMEACILLWHMPDLLVFNVCVNFGMLLIIRCLTLKIGGSKHTMNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAK

SEQ ID NO: 25855 - protein, 568 aa, Homo sapiens
  Payload ID: 5125
  Gene Symbol: DYRK3
  Gene Name: dual-specificity tyrosine-(Y)-phosphorylation regulated kinase 3
  Uniprot ID: O43781
  ENSP ID: ENSP00000356073
MKWKEKLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQDKTGSMNVIHMLESFTFRNHVCMAFELLSIDLYELIKKNKFQGFSVQLVRKFAQSILQSLDALHKNKIIHCDLKPENILLKHHGRSSTKVIDFGSSCFEYQKLYTYIQSRFYRAPEIILGSRYSTPIDIWSFGCILAELLTGQPLFPGEDEGDQLACMMELLGMPPPKLLEQSKRAKYFINSKGIPRYCSVTTQADGRVVLVGGRSRRGKKRGPPGSKDWGTALKGCDDYLFIEFLKRCLHWDPSARLTPAQALRHPWISKSVPRPLTTIDKVSGKRVVNPASAFQGLGSKLPPVVGIANKLKANLMSETNGSIPLCSVLPKLIS

SEQ ID NO: 25856 - protein, 568 aa, Homo sapiens; identical to SEQ ID NO: 25855
  Payload ID: 5125
  Gene Symbol: DYRK3
  Gene Name: dual-specificity tyrosine-(Y)-phosphorylation regulated kinase 3
  Uniprot ID: O43781
  ENSP ID: ENSP00000356075

SEQ ID NO: 25857 - protein, 588 aa, Homo sapiens
  Payload ID: 5125
  Gene Symbol: DYRK3
  Gene Name: dual-specificity tyrosine-(Y)-phosphorylation regulated kinase 3
  Uniprot ID: O43781
  ENSP ID: ENSP00000356076
MGGTARGPGRKDAGPPGAGLPPQQRRLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQDKTGSMNVIHMLESFTFRNHVCMAFELLSIDLYELIKKNKFQGFSVQLVRKFAQSILQSLDALHKNKIIHCDLKPENILLKHHGRSSTKVIDFGSSCFEYQKLYTYIQSRFYRAPEIILGSRYSTPIDIWSFGCILAELLTGQPLFPGEDEGDQLACMMELLGMPPPKLLEQSKRAKYFINSKGIPRYCSVTTQADGRVVLVGGRSRRGKKRGPPGSKDWGTALKGCDDYLFIEFLKRCLHWDPSARLTPAQALRHPWISKSVPRPLTTIDKVSGKRVVNPASAFQGLGSKLPPVVGIANKLKANLMSETNGSIPLCSVLPKLIS

SEQ ID NO: 25858 - protein, 243 aa, Homo sapiens
  Payload ID: 5125
  Gene Symbol: DYRK3
  Gene Name: dual-specificity tyrosine-(Y)-phosphorylation regulated kinase 3
  ENSP ID: ENSP00000410187
MKWKEKLGDGVYDTFMMIDETKCPPCSNVLCNPSEPPPPRRLNMTTEQFTGDHTQHFLDGGEMKVEQLFQEFGNRKSNTIQSDGISDSEKCSPTVSQGKSSDCLNTVKSNSSSKAPKVVPLTPEQALKQYKHHLTAYEKLEIINYPEIYFVGPNAKKRHGVIGGPNNGGYDDADGAYIHVPRDHLAYRYEVLKIIGKGSFGQVARVYDHKLRQYVALKMVRNEKRFHRQAAEEIRILEHLKKQ

SEQ ID NO: 25859 - protein, 520 aa, Homo sapiens
  Payload ID: 5126
  Gene Symbol: DYRK4
  Gene Name: dual-specificity tyrosine-(Y)-phosphorylation regulated kinase 4
  Uniprot ID: Q9NR20
  ENSP ID: ENSP00000010132
MPASELKASEIPFHPSIKTQDPKAEEKSPKKQKVTLTAAEALKLFKNQLSPYEQSEILGYAELWFLGLEAKKLDTAPEKFSKTSFDDEHGFYLKVLHDHIAYRYEVLETIGKGSFGQVAKCLDHKNNELVALKIIRNKKRFHQQALMELKILEALRKKDKDNTYNVVHMKDFFYFRNHFCITFELLGINLYELMKNNNFQGFSLSIVRRFTLSVLKCLQMLSVEKIIHCDLKPENIVLYQKGQASVKVIDFGSSCYEHQKVYTYIQSRFYRSPEVILGHPYDVAIDMWSLGCITAELYTGYPLFPGENEVEQLACIMEVLGLPPAGFIQTASRRQTFFDSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKADEITKETTEKTKDSPTKHVQHSGDQQDCLQHGADTVQLPQLVDAPKKSEAAVGAEVSMTSPGQSKNFSLKNTNVLPPIV

SEQ ID NO: 25860 - protein, 120 aa, Homo sapiens
  Payload ID: 5126
  Gene Symbol: DYRK4
  Gene Name: dual-specificity tyrosine-(Y)-phosphorylation regulated kinase 4
  ENSP ID: ENSP00000438769
  MOD_RES (1)..(1): Any amino acid
XSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKGTACQITSPSPTVRELIF

SEQ ID NO: 25861 - protein, 43 aa, Homo sapiens
  Payload ID: 5126
  Gene Symbol: DYRK4
  Gene Name: dual-specificity tyrosine-(Y)-phosphorylation regulated kinase 4
  ENSP ID: ENSP00000439168
MQLLPPPIRTGTKLKWRLGKSRRPFSGKVQTVETTNENVLCLA

SEQ ID NO: 25862 - protein, 634 aa, Homo sapiens
  Payload ID: 5126
  Gene Symbol: DYRK4
  Gene Name: dual-specificity tyrosine-(Y)-phosphorylation regulated kinase 4
  ENSP ID: ENSP00000439697
MQLLPPPIRTGTKTQMDAKKPRKCDLTPFLVLKARKKQKFTSAKVGSKLSVQIQKPPSNIKNSRMTQVFHKNTSVTSLPFVDTKGKKNTVSFPHISKKVLLKSSLLYQENQAHNQMPASELKASEIPFHPSIKTQDPKAEEKSPKKQKVTLTAAEALKLFKNQLSPYEQSEILGYAELWFLGLEAKKLDTAPEKFSKTSFDDEHGFYLKVLHDHIAYRYEVLETIGKGSFGQVAKCLDHKNNELVALKIIRNKKRFHQQALMELKILEALRKKDKDNTYNVVHMKDFFYFRNHFCITFELLGINLYELMKNNNFQGFSLSIVRRFTLSVLKCLQMLSVEKIIHCDLKPENIVLYQKGQASVKVIDFGSSCYEHQKVYTYIQSRFYRSPEVILGHPYDVAIDMWSLGCITAELYTGYPLFPGENEVEQLACIMEVLGLPPAGFIQTASRRQTFFDSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKDEITKETTEKTKDSPTKHVQHSGDQQDCLQHGADTVQLPQLVDAPKKSEAAVGAEVSMTSPGQSKNFSLKNTNVLPPIV

SEQ ID NO: 25863 - protein, 520 aa, Homo sapiens; identical to SEQ ID NO: 25859
  Payload ID: 5126
  Gene Symbol: DYRK4
  Gene Name: dual-specificity tyrosine-(Y)-phosphorylation regulated kinase 4
  Uniprot ID: Q9NR20
  ENSP ID: ENSP00000441755

SEQ ID NO: 25864 - protein, 68 aa, Homo sapiens
  Payload ID: 5126
  Gene Symbol: DYRK4
  Gene Name: dual-specificity tyrosine-(Y)-phosphorylation regulated kinase 4
  ENSP ID: ENSP00000441996
MQLLPPPIRTGTKTQMDAKKPRKCDLTPFLVLKARKKQKFTSAKGPTLSEIYMEETRRSQLRKQENRL

SEQ ID NO: 25865 - protein, 59 aa, Homo sapiens
  Payload ID: 5126
  Gene Symbol: DYRK4
  Gene Name: dual-specificity tyrosine-(Y)-phosphorylation regulated kinase 4
  ENSP ID: ENSP00000444842
MQLLPPPIRTGTKTQMDAKKPRKCDLTPFLVLKARKKQKFTSAKEETRRSQLRKQENRL

SEQ ID NO: 25866 - protein, 669 aa, Homo sapiens
  Payload ID: 5127
  Gene Symbol: DYM
  Gene Name: dymeclin
  Uniprot ID: Q7RTS9
  ENSP ID: ENSP00000269445
MGSNSSRIGDLPKNEYLKKLSGTESISENDPFWNQLLSFSFPAPTSSSELKLLEEATISVCRSLVENNPRTGNLGALIKVFLSRTKELKLSAECQNHIFIWQTHNALFIICCLLKVFICQMSEEELQLHFTYEEKSPGNYSSDSEDLLEELLCCLMQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANLTDASDAPNPYRQAIMSFKNTQDSSPFPSSIPHAFQINFNSLYTALCEQQTSDQATLLLYTLLHQNSNIRTYMLARTDMENLVLPILEILYHVEERNSHHVYMALIILLILTEDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYAQDLNVIEEVIRMMLEIINSCLTNSLHHNPNLVYALLYKRDLFEQFRTHPSFQDIMQNIDLVISFFSSRLLQAGAELSVERVLEIIKQGVVALPKDRLKKFPELKFKYVEEEQPEEFFIPYVWSLVYNSAVGLYWNPQDIQLFTMDSD

SEQ ID NO: 25867 - protein, 479 aa, Homo sapiens
  Payload ID: 5127
  Gene Symbol: DYM
  Gene Name: dymeclin
  Uniprot ID: Q7RTS9
  ENSP ID: ENSP00000395942
MGSNSSRIGDLPKNEYLKKLSGTESISENDPFWNQLLSFSFPAPTSSSELKLLEEATISVCRSLAGLWTVFTLGGVGSKAAASPELSSPLANQSLLLLLVLANLTDASDAPNPYRQAIMSFKNTQDSSPFPSSIPHAFQINFNSLYTALCEQQTSDQATLLLYTLLHQNSNIRTYMLARTDMENLVLPILEILYHVEERNSHHVYMALIILLILTEDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYAQDLNVIEEVIRMMLEIINSCLTNSLHHNPNLVYALLYKRDLFEQFRTHPSFQDIMQNIDLVISFFSSRLLQAGAELSVERVLEIIKQGVVALPKDRLKKFPELKFKYVEEEQPEEFFIPYVWSLVYNSAVGLYWNPQDIQLFTMDSD

SEQ ID NO: 25868 - protein, 39 aa, Homo sapiens
  Payload ID: 5127
  Gene Symbol: DYM
  Gene Name: dymeclin
  ENSP ID: ENSP00000415292
MSEPHLHLADTQCFVYYLLFAESVHLSDVRGGITTSFYL

SEQ ID NO: 25869 - protein, 163 aa, Homo sapiens
  Payload ID: 5127
  Gene Symbol: DYM
  Gene Name: dymeclin
  ENSP ID: ENSP00000461989
MQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANLTDASDAPNPYRQAIMSFKNTQDSS

SEQ ID NO: 25870 - protein, 139 aa, Homo sapiens
  Payload ID: 5127
  Gene Symbol: DYM
  Gene Name: dymeclin
  ENSP ID: ENSP00000462466
MQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANL

SEQ ID NO: 25871 - protein, 122 aa, Homo sapiens
  Payload ID: 5127
  Gene Symbol: DYM
  Gene Name: dymeclin
  ENSP ID: ENSP00000462657
  MOD_RES (1)..(1): Any amino acid
XIQYNMTRTRDKYLHTNCLAALANMSAQFRSLHQYAAQRIISYTCRHLRRYVYVLDKLYFPHSHCSTLQHCFSTLSDNGEELLSLTCSHILRSYASSLFSLLSKKHNKVLEQATQSLRGSLS

SEQ ID NO: 25872 - protein, 74 aa, Homo sapiens
  Payload ID: 5127
  Gene Symbol: DYM
  Gene Name: dymeclin
  ENSP ID: ENSP00000462954
MGSNSSRIGDLPKNEYLKKLSGTESISENDPFWNQLLSFSFPAPTSRQSFTLVAQAGVQWHDLGSPQPLPPGIK

SEQ ID NO: 25873 - protein, 116 aa, Homo sapiens
  Payload ID: 5127
  Gene Symbol: DYM
  Gene Name: dymeclin
  ENSP ID: ENSP00000463892
MQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVANLKGRLMASFMLQIVEE

SEQ ID NO: 25874 - protein, 109 aa, Homo sapiens
  Payload ID: 5127
  Gene Symbol: DYM
  Gene Name: dymeclin
  ENSP ID: ENSP00000464089
MGSNSSRIGDLPKNEYLKKLSGTESISENDPFWNQLLSFSFPAPTSSSELKLLEEATISVCRSLVENNPRTGNLGALIKVFLSRTKELKLSAECQNHIFIWQTHNALFI

SEQ ID NO: 25875 - protein, 67 aa, Homo sapiens
  Payload ID: 5127
  Gene Symbol: DYM
  Gene Name: dymeclin
  ENSP ID: ENSP00000464163
  MOD_RES (1)..(1): Any amino acid
XLLQAGAELSVERVLEIIKQGVVALPKDRLKPLADRQVDRVLACQAFVYAASGFSQFHGLSVRNFQN

SEQ ID NO: 25876 - protein, 142 aa, Homo sapiens
  Payload ID: 5127
  Gene Symbol: DYM
  Gene Name: dymeclin
  ENSP ID: ENSP00000464183
MQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANLTDA

SEQ ID NO: 25877 - protein, 141 aa, Homo sapiens
  Payload ID: 5127
  Gene Symbol: DYM
  Gene Name: dymeclin
  ENSP ID: ENSP00000464653
MQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVARLWTVFTLGGVGSKAAASPELSSPLANQSLLLLLVLANLTDA

SEQ ID NO: 25878 - protein, 1278 aa, Homo sapiens
  Payload ID: 5128
  Gene Symbol: DCTN1
  Gene Name: dynactin 1
  Uniprot ID: Q14203
  ENSP ID: ENSP00000354791
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 25879 - protein, 1271 aa, Homo sapiens
  Payload ID: 5128
  Gene Symbol: DCTN1
  Gene Name: dynactin 1
  Uniprot ID: Q14203
  ENSP ID: ENSP00000377571
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 25880 - protein, 1236 aa, Homo sapiens
  Payload ID: 5128
  Gene Symbol: DCTN1
  Gene Name: dynactin 1
  Uniprot ID: Q14203
  ENSP ID: ENSP00000386406
MSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 25881 - protein, 1253 aa, Homo sapiens
  Payload ID: 5128
  Gene Symbol: DCTN1
  Gene Name: dynactin 1
  Uniprot ID: Q14203
  ENSP ID: ENSP00000386843
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 25882 - protein, 1139 aa, Homo sapiens
  Payload ID: 5128
  Gene Symbol: DCTN1
  Gene Name: dynactin 1
  Uniprot ID: Q14203
  ENSP ID: ENSP00000387270
MMRQAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 25883 - protein, 1256 aa, Homo sapiens
  Payload ID: 5128
  Gene Symbol: DCTN1
  Gene Name: dynactin 1
  ENSP ID: ENSP00000387327
MSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 25884 - protein, 87 aa, Homo sapiens
  Payload ID: 5128
  Gene Symbol: DCTN1
  Gene Name: dynactin 1
  ENSP ID: ENSP00000395312
MSAEASARPLRVGSRVEVIGKGHRGTVAYVGATLFATGKWVGVILDEAKGKNDGTVQGRKYFTCDEGHGIFVRQSQIQVFEDGADTT

SEQ ID NO: 25885 - protein, 64 aa, Homo sapiens
  Payload ID: 5128
  Gene Symbol: DCTN1
  Gene Name: dynactin 1
  ENSP ID: ENSP00000400059
MSAEASARPLRVGSRVEVIGKGHRGTVAYVGATLFATGKWVGVILDEAKGKNDGTVQGRKYFTC

SEQ ID NO: 25886 - protein, 135 aa, Homo sapiens
  Payload ID: 5128
  Gene Symbol: DCTN1
  Gene Name: dynactin 1
  ENSP ID: ENSP00000402509
MCCLERVTLSVQAYKTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKL

SEQ ID NO: 25887 - protein, 121 aa, Homo sapiens
  Payload ID: 5128
  Gene Symbol: DCTN1
  Gene Name: dynactin 1
  ENSP ID: ENSP00000404038
MSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKK

SEQ ID NO: 25888 - protein, 13 aa, Homo sapiens
  Payload ID: 5128
  Gene Symbol: DCTN1
  Gene Name: dynactin 1
  ENSP ID: ENSP00000407484
MSAEASARPLRVG

SEQ ID NO: 25889 - protein, 76 aa, Homo sapiens
  Payload ID: 5128
  Gene Symbol: DCTN1
  Gene Name: dynactin 1
  ENSP ID: ENSP00000409363
MSAEASARPLRVGSRVEVIGKGHRGTVAYVGATLFATGKWVGVILDEAKGKNDGTVQGRKYFTCDEGHGIFVRQSQ

SEQ ID NO: 25890 - protein, 76 aa, Homo sapiens; identical to SEQ ID NO: 25889
  Payload ID: 5128
  Gene Symbol: DCTN1
  Gene Name: dynactin 1
  ENSP ID: ENSP00000413268

SEQ ID NO: 25891 - protein, 186 aa, Homo sapiens
  Payload ID: 5128
  Gene Symbol: DCTN1
  Gene Name: dynactin 1
  ENSP ID: ENSP00000414315
MLMGLLRPYILGERGTVMTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELS

SEQ ID NO: 25892 - protein, 890 aa, Homo sapiens
  Payload ID: 5128
  Gene Symbol: DCTN1
  Gene Name: dynactin 1
  ENSP ID: ENSP00000416711
MSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQVGLDGWVEGVGRVSDQCGAFTSALGSCRSMGPPPAAPMSVCASHATSSSVP

SEQ ID NO: 25893 - protein, 1256 aa, Homo sapiens; identical to SEQ ID NO: 25883
  Payload ID: 5128
  Gene Symbol: DCTN1
  Gene Name: dynactin 1
  ENSP ID: ENSP00000487279

SEQ ID NO: 25894 - protein, 1144 aa, Homo sapiens
  Payload ID: 5128
  Gene Symbol: DCTN1
  Gene Name: dynactin 1
  Uniprot ID: Q14203
  ENSP ID: ENSP00000487724
MMRQAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 25895 - protein, 406 aa, Homo sapiens
  Payload ID: 5129
  Gene Symbol: DCTN2
  Gene Name: dynactin 2 (p50)
  Uniprot ID: Q13561
  ENSP ID: ENSP00000408910
MADPKYADLPGIARNEPDVYETSDLPEDDQAEFDAFAQELEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 25896 - protein, 403 aa, Homo sapiens
  Payload ID: 5129
  Gene Symbol: DCTN2
  Gene Name: dynactin 2 (p50)
  Uniprot ID: Q13561
  ENSP ID: ENSP00000439376
MADPKYADLPGIARNEPDVYETSDLPEDDQAEFDAELEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 25897 - protein, 315 aa, Homo sapiens
  Payload ID: 5129
  Gene Symbol: DCTN2
  Gene Name: dynactin 2 (p50)
  ENSP ID: ENSP00000446964
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKPCSLVSS

SEQ ID NO: 25898 - protein, 128 aa, Homo sapiens
  Payload ID: 5129
  Gene Symbol: DCTN2
  Gene Name: dynactin 2 (p50)
  ENSP ID: ENSP00000447308
EELTSTSVEHIIVNPNAAYDKFKDKRVGTKGLDFSDRIGKTKRTGYESGEYEMLGEGLGVKETPQQKYQRLLHEVQELTTEVEKIKNPLSAGLQGACLMETVELLQAKVSALDLAVLDQVEARLQSVL

SEQ ID NO: 25899 - protein, 45 aa, Homo sapiens
  Payload ID: 5129
  Gene Symbol: DCTN2
  Gene Name: dynactin 2 (p50)
  ENSP ID: ENSP00000447553
MADPKYADLPGIARNEPDVYETSDLPEDDQAEFDAFAQIFKTLLE

SEQ ID NO: 25900 - protein, 401 aa, Homo sapiens
  Payload ID: 5129
  Gene Symbol: DCTN2
  Gene Name: dynactin 2 (p50)
  Uniprot ID: Q13561
  ENSP ID: ENSP00000447824
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 25901 - protein, 152 aa, Homo sapiens
  Payload ID: 5129
  Gene Symbol: DCTN2
  Gene Name: dynactin 2 (p50)
  ENSP ID: ENSP00000448606
MADPKYADLPGIARNEPDVYETSDLPEDDQAEFDAEELTSTSVEHIIVNPNAAYDKFKDKRVGTKGLDFSDRIGKTKRTGYESGEYEMLGEGLGVKETPQQKYQRLLHEVQELTTEVEKIKVAELEKRLTELETAVRCDQDAQNPLSAGLQG

SEQ ID NO: 25902 - protein, 268 aa, Homo sapiens
  Payload ID: 5129
  Gene Symbol: DCTN2
  Gene Name: dynactin 2 (p50)
  ENSP ID: ENSP00000448937
VEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 25903 - protein, 135 aa, Homo sapiens
  Payload ID: 5129
  Gene Symbol: DCTN2
  Gene Name: dynactin 2 (p50)
  ENSP ID: ENSP00000449710
MADPKYADLPGIEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLL

SEQ ID NO: 25904 - protein, 278 aa, Homo sapiens
  Payload ID: 5129
  Gene Symbol: DCTN2
  Gene Name: dynactin 2 (p50)
  ENSP ID: ENSP00000449855
MADPKYADLPGIARNEPDVYETSDLPEDDQAEFDAELVRSLTFHLLFNGEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELL

SEQ ID NO: 25905 - protein, 186 aa, Homo sapiens
  Payload ID: 5130
  Gene Symbol: DCTN3
  Gene Name: dynactin 3 (p22)
  Uniprot ID: O75935
  ENSP ID: ENSP00000259632
MAGLTDLQRLQARVEELERWVYGPGGARGSRKVADGLVKVQVALGNISSKRERVKILYKKIEDLIKYLDPEYIDRIAIPDASKLQFILAEEQFILSQVALLEQVNALVPMLDSAHIKAVPEHAARLQRLAQIHIQQQDQCVEITEESKALLEEYNKTTMLLSKQFVQWDELLCQLEAATQVKPAEE

SEQ ID NO: 25906 - protein, 176 aa, Homo sapiens
  Payload ID: 5130
  Gene Symbol: DCTN3
  Gene Name: dynactin 3 (p22)
  Uniprot ID: O75935
  ENSP ID: ENSP00000343986
MAGLTDLQRLQARVEELERWVYGPGGARGSRKVADGLVKVQVALGNISSKRERVKILYKKIEDLIKYLDPEYIDRIAIPDASKLQFILAEEQFILSQVALLEQVNALVPMLDSAHIKAVPEHAARLQRLAQIHIQQQAPWGVGVRDEAGSLVEDVGFAQFLSVLHFGPTGPVCGNH

SEQ ID NO: 25907 - protein, 160 aa, Homo sapiens
  Payload ID: 5130
  Gene Symbol: DCTN3
  Gene Name: dynactin 3 (p22)
  ENSP ID: ENSP00000368191
MAGLTDLQRLQARVEELERWVYGPGGARGSRKVADGLVKVQVALGNISSKRERVKILYKKIEDLIKYLDPEYIDRIAIPDASKLQFILAGNAGLHVYMHLRMWVVGEVKHRDGLSIQSSGGYKPWMLLSGIVAWFWVEDPMDPLVDIEYSIPLHQLQAMV

SEQ ID NO: 25908 - protein, 142 aa, Homo sapiens
  Payload ID: 5130
  Gene Symbol: DCTN3
  Gene Name: dynactin 3 (p22)
  ENSP ID: ENSP00000368193
MAGLTDLQRLQARVEELERWVYGPGGARGSRKVADGLVKVQVALGNISSKRERVKILYKKIEDLIKYLDPEYIDRIAIPDASKLQFILAEEQFILSQVALLEQVNALVPMLDSAHIKAVPEHAARLQRLAQIHIQQQVWEGR

SEQ ID NO: 25909 - protein, 158 aa, Homo sapiens
  Payload ID: 5130
  Gene Symbol: DCTN3
  Gene Name: dynactin 3 (p22)
  Uniprot ID: O75935
  ENSP ID: ENSP00000368196
MAGLTDLQRLQARVEELERWVYGPGGARGSRKVADGLVKVQVALGNISSKRERVKILYKKIEDLIKYLDPEYIDRIAIPDASKLQFILAAVPEHAARLQRLAQIHIQQQDQCVEITEESKALLEEYNKTTMLLSKQFVQWDELLCQLEAATQVKPAEE

SEQ ID NO: 25910 - protein, 151 aa, Homo sapiens
  Payload ID: 5130
  Gene Symbol: DCTN3
  Gene Name: dynactin 3 (p22)
  ENSP ID: ENSP00000390842
QRLQARVEELERWVYGPGGARGSRKVADGLVKVQVALGNISSKRERVKILYKKIEDLIKYLDPEYIDRIAIPDASKLQFILAAVPEHAARLQRLAQIHIQQQDQCVEITEESKALLEEYNKTTMLLSKQFVQWDELLCQLEAATQVKPAEE

SEQ ID NO: 25911 - protein, 176 aa, Homo sapiens
  Payload ID: 5130
  Gene Symbol: DCTN3
  Gene Name: dynactin 3 (p22)
  ENSP ID: ENSP00000432915
MAGLTDLQRLQARVEELERWVYGPGGARGSRKVADGLVKVQVALGNISSKRERVKILYKKIEDLIKYLDPEYIDRIAIPDASKLQFILAEEQFILSQVALLEQVNALVPMLDSAHIKAVPEHAARLQRLAQIHIQQQIPILTLTYNQTMLLSKQFVQWDELLCQLEAATQVKPAEE

SEQ ID NO: 25912 - protein, 403 aa, Homo sapiens
  Payload ID: 5131
  Gene Symbol: DCTN4
  Gene Name: dynactin 4 (p62)
  Uniprot ID: Q9UJW0
  ENSP ID: ENSP00000411251
MPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRRNYMPLAFSDKYGLGTRLQRPRAGASISTLAGLSLKEGEDQKEIKIEPAQAVDEVEPLPEDYYTRPVNLTEVTTLQQRLLQPDFQPVCASQLYPRHKHLLIKRSLRCRKCEHNLSKPEFNPTSIKFKIQLVAVNYIPEVRIMSIPNLRYMKESQVLLTLTNPVENLTHVTLFECEEGDPDDINSTAKVVVPPKELVLAGKDAAAEYDELAEPQDFQDDPDIIAFRKANKVGIFIKVTPQREEGEVTVCFKMKHDFKNLAAPIRPIEESDQGTEVIWLTQHVELSLGPLLP

SEQ ID NO: 25913 - protein, 467 aa, Homo sapiens
  Payload ID: 5131
  Gene Symbol: DCTN4
  Gene Name: dynactin 4 (p62)
  Uniprot ID: Q9UJW0
  ENSP ID: ENSP00000414906
MASLLQSDRVLYLVQGEKKVRAPLSQLYFCRYCSELRSLECVSHEVDSHYCPSCLENMPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRRNYMPLAFSQHTIHVVDKYGLGTRLQRPRAGASISTLAGLSLKEGEDQKEIKIEPAQAVDEVEPLPEDYYTRPVNLTEVTTLQQRLLQPDFQPVCASQLYPRHKHLLIKRSLRCRKCEHNLSKPEFNPTSIKFKIQLVAVNYIPEVRIMSIPNLRYMKESQVLLTLTNPVENLTHVTLFECEEGDPDDINSTAKVVVPPKELVLAGKDAAAEYDELAEPQDFQDDPDIIAFRKANKVGIFIKVTPQREEGEVTVCFKMKHDFKNLAAPIRPIEESDQGTEVIWLTQHVELSLGPLLP

SEQ ID NO: 25914 - protein, 460 aa, Homo sapiens
  Payload ID: 5131
  Gene Symbol: DCTN4
  Gene Name: dynactin 4 (p62)
  Uniprot ID: Q9UJW0
  ENSP ID: ENSP00000416968
MASLLQSDRVLYLVQGEKKVRAPLSQLYFCRYCSELRSLECVSHEVDSHYCPSCLENMPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRRNYMPLAFSDKYGLGTRLQRPRAGASISTLAGLSLKEGEDQKEIKIEPAQAVDEVEPLPEDYYTRPVNLTEVTTLQQRLLQPDFQPVCASQLYPRHKHLLIKRSLRCRKCEHNLSKPEFNPTSIKFKIQLVAVNYIPEVRIMSIPNLRYMKESQVLLTLTNPVENLTHVTLFECEEGDPDDINSTAKVVVPPKELVLAGKDAAAEYDELAEPQDFQDDPDIIAFRKANKVGIFIKVTPQREEGEVTVCFKMKHDFKNLAAPIRPIEESDQGTEVIWLTQHVELSLGPLLP

SEQ ID NO: 25915 - protein, 91 aa, Homo sapiens
  Payload ID: 5131
  Gene Symbol: DCTN4
  Gene Name: dynactin 4 (p62)
  ENSP ID: ENSP00000428987
MNKLIEYYQQLAQKEKVERDRKKLARRRNYMPLAFSDKYGLGTRLQRPRAGASISTLAGLSLKEGEDQKEIKIEPAQAVDEVEPLPEDYYT

SEQ ID NO: 25916 - protein, 86 aa, Homo sapiens
  Payload ID: 5131
  Gene Symbol: DCTN4
  Gene Name: dynactin 4 (p62)
  ENSP ID: ENSP00000429489
MASLLQSDRVLYLVQGEKKVRAPLSQLYFCRYCSELRSLECVSHEVDSHYCPSCLENMPSAEAKLKKNRLGECILRRRTTEMCQLF

SEQ ID NO: 25917 - protein, 114 aa, Homo sapiens
  Payload ID: 5131
  Gene Symbol: DCTN4
  Gene Name: dynactin 4 (p62)
  ENSP ID: ENSP00000430183
MPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRR

SEQ ID NO: 25918 - protein, 134 aa, Homo sapiens
  Payload ID: 5131
  Gene Symbol: DCTN4
  Gene Name: dynactin 4 (p62)
  ENSP ID: ENSP00000430993
MPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRRNYMPLAFSDKYGLGTRLQRP

SEQ ID NO: 25919 - protein, 86 aa, Homo sapiens; identical to SEQ ID NO: 25916
  Payload ID: 5131
  Gene Symbol: DCTN4
  Gene Name: dynactin 4 (p62)
  ENSP ID: ENSP00000431042

SEQ ID NO: 25920 - protein, 86 aa, Homo sapiens; identical to SEQ ID NO: 25916
  Payload ID: 5131
  Gene Symbol: DCTN4
  Gene Name: dynactin 4 (p62)
  ENSP ID: ENSP00000487323

SEQ ID NO: 25921 - protein, 182 aa, Homo sapiens
  Payload ID: 5132
  Gene Symbol: DCTN5
  Gene Name: dynactin 5 (p25)
  Uniprot ID: Q9BTE1
  ENSP ID: ENSP00000300087
MELGELLYNKSEYIETASGNKVSRQSVLCGSQNIVLNGKTIVMNDCIIRGDLANVRVGRHCVVKSRSVIRPPFKKFSKGVAFFPLHIGDHVFIEEDCVVNAAQIGSYVHVGKNCVIGRRCVLKDCCKILDNTVLPPETVVPPFTVFSGCPGLFSGELPECTQELMIDVTKSYYQKFLPLTQV

SEQ ID NO: 25922 - protein, 152 aa, Homo sapiens
  Payload ID: 5132
  Gene Symbol: DCTN5
  Gene Name: dynactin 5 (p25)
  Uniprot ID: Q9BTE1
  ENSP ID: ENSP00000454691
MELGELLYNKSEYIETASGNKVSRQSVLCGSQNIVLNGKTIVMNDCIIRGDLANVRVGRHCVVKSRSVIRPPFKKFSKGVAFFPLHIGDHVFIEEDCVVNAAQIGSYVHVGKNCVIGRRCVLKDCCKILDNTVLPPETVVPPFTVFSGCPAP

SEQ ID NO: 25923 - protein, 84 aa, Homo sapiens
  Payload ID: 5132
  Gene Symbol: DCTN5
  Gene Name: dynactin 5 (p25)
  Uniprot ID: Q9BTE1
  ENSP ID: ENSP00000455685
MELGELLYNKSEYIETASGNKVSRQSVLCGSQNIVLNGKNFVISVFLSPYIRCHSACRDRKRSDESVRLSVNNREWWGLVNWRM

SEQ ID NO: 25924 - protein, 155 aa, Homo sapiens
  Payload ID: 5132
  Gene Symbol: DCTN5
  Gene Name: dynactin 5 (p25)
  ENSP ID: ENSP00000456137
MELGELLYNKSEYIETASGNKVSRQSVLCGSQNIVLNGKTIVMNDCIIRGDLANVRVGRHCVVKSRSVIRPPFKKFSKGVAFFPLHIGDHVFIEEDCVVNAAQIGSYVHVGKNCVIGRRCVLKDCCKILDNTVLPPETVVPPFTVFSGCPGNLGC

SEQ ID NO: 25925 - protein, 75 aa, Homo sapiens
  Payload ID: 5132
  Gene Symbol: DCTN5
  Gene Name: dynactin 5 (p25)
  ENSP ID: ENSP00000456483
MELGELLYNKSEYIETASGNKVSRQSVLCGSQNIVLNGKAGVQWRDLGSLQPPPPRFKRFSCLSLPSSWDYCRPL

SEQ ID NO: 25926 - protein, 53 aa, Homo sapiens
  Payload ID: 5132
  Gene Symbol: DCTN5
  Gene Name: dynactin 5 (p25)
  ENSP ID: ENSP00000457585
MELGELLYNKSEYIETASGNKVSRQSVLCGSQNIVLNGKCCILSFTYWRPCLY

SEQ ID NO: 25927 - protein, 99 aa, Homo sapiens
  Payload ID: 5132
  Gene Symbol: DCTN5
  Gene Name: dynactin 5 (p25)
  ENSP ID: ENSP00000458354
MNDCIIRGDLANVRVGRHCVVKSRSVIRPPFKKFSKGVAFFPLHIGDHVFIEEDCVVNAAQIGSYVHVGKNCVIGRRCVLKDCCKILDNTVLPPETVVP

SEQ ID NO: 25928 - protein, 190 aa, Homo sapiens
  Payload ID: 5133
  Gene Symbol: DCTN6
  Gene Name: dynactin 6
  Uniprot ID: O00399
  ENSP ID: ENSP00000221114
MAEKTQKSVKIAPGAVVCVESEIRGDVTIGPRTVIHPKARIIAEAGPIVIGEGNLIEEQALIINAYPDNITPDTEDPEPKPMIIGTNNVFEVGCYSQAMKMGDNNVIESKAYVGRNVILTSGCIIGACCNLNTFEVIPENTVIYGADCLRRVQTERPQPQTLQLDFLMKILPNYHHLKKTMKGSSTPVKN

SEQ ID NO: 25929 - protein, 73 aa, Homo sapiens
  Payload ID: 5133
  Gene Symbol: DCTN6
  Gene Name: dynactin 6
  ENSP ID: ENSP00000427955
MAEKTQKSVKIAPGAVVCVESEIRGDVTIGPRTVIHPKARIIAEAGPIVIGEGNLIEEQALIINAFPSHEDGR

SEQ ID NO: 25930 - protein, 37 aa, Homo sapiens
  Payload ID: 5133
  Gene Symbol: DCTN6
  Gene Name: dynactin 6
  ENSP ID: ENSP00000429408
MAEKTQKSVKIAPGAVVCVESEIRGDVTIAGHGGACL

SEQ ID NO: 25931 - protein, 46 aa, Homo sapiens
  Payload ID: 5133
  Gene Symbol: DCTN6
  Gene Name: dynactin 6
  ENSP ID: ENSP00000430109
MAEKTQKSVKIAPGAVVCVESEIRGDVTIVTQIISLLTLKIQNQNL

SEQ ID NO: 25932 - protein, 170 aa, Homo sapiens
  Payload ID: 5133
  Gene Symbol: DCTN6
  Gene Name: dynactin 6
  ENSP ID: ENSP00000431017
MAEKTQKSVKIAPGAVVCVESEIRGDVTIGPRTVIHPKARIIAEAGPIVIGEGNLIEEQALIINAYPDNITPDTEDPEPKPMIIGTNNVFEVGCYSQAMKMGDNNVIESKAYVGRNVILTSGCIIGACCNLNTFEVIPENTVIYGADCLRRVQTERPQVLEPLFKKSSIC

SEQ ID NO: 25933 - protein, 210 aa, Homo sapiens
  Payload ID: 5134
  Gene Symbol: DYNAP
  Gene Name: dynactin associated protein
  Uniprot ID: Q8N1N2
  ENSP ID: ENSP00000315265
MVADIKGNEQIEKYSWREACDTGSSRMDRKHGKYILNVEHSENQPPITHPNDQEAHSSICWCLPSNDITSDVSPNLTGVCVNPGILAHSRCLQSESCNTQVKEYCRNDWSMWKVFLACLLACVIMTAIGVLIICLVNNKGSANSSIVIQLSTNDGECVTVKPGTPSPACPPTMTTTSTVPASTATESTTSTATAATTSTEPITVAPTDHL

SEQ ID NO: 25934 - protein, 158 aa, Homo sapiens
  Payload ID: 5134
  Gene Symbol: DYNAP
  Gene Name: dynactin associated protein
  ENSP ID: ENSP00000466577
MEYQLLDIKGNEQIEKYSWREACDTGSSRMDRKHGKYILNVEHSENQPVKEYCRNDWSMWKVFLACLLACVIMTAIGVLIICLVNNKGSANSSIVIQLSTNDGECVTVKPGTPSPACPPTMTTTSTVPASTATESTTSTATAATTSTEPITVAPTDHL

SEQ ID NO: 25935 - protein, 851 aa, Homo sapiens
  Payload ID: 5135
  Gene Symbol: DNM1
  Gene Name: dynamin 1
  Uniprot ID: Q05193
  ENSP ID: ENSP00000345680
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPRITISDP

SEQ ID NO: 25936 - protein, 864 aa, Homo sapiens
  Payload ID: 5135
  Gene Symbol: DNM1
  Gene Name: dynamin 1
  Uniprot ID: Q05193
  ENSP ID: ENSP00000362014
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPSRSGQASPSRPESPRPPFDL

SEQ ID NO: 25937 - protein, 851 aa, Homo sapiens
  Payload ID: 5135
  Gene Symbol: DNM1
  Gene Name: dynamin 1
  Uniprot ID: Q05193
  ENSP ID: ENSP00000377219
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDLAFEATVKKQVQKLKEPSIKCVDMVVSELTATIRKCSEKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPRITISDP

SEQ ID NO: 25938 - protein, 851 aa, Homo sapiens; identical to SEQ ID NO: 25937
  Payload ID: 5135
  Gene Symbol: DNM1
  Gene Name: dynamin 1
  Uniprot ID: Q05193
  ENSP ID: ENSP00000419225

SEQ ID NO: 25939 - protein, 864 aa, Homo sapiens
  Payload ID: 5135
  Gene Symbol: DNM1
  Gene Name: dynamin 1
  Uniprot ID: Q05193
  ENSP ID: ENSP00000420045
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDLAFEATVKKQVQKLKEPSIKCVDMVVSELTATIRKCSEKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPSRSGQASPSRPESPRPPFDL

SEQ ID NO: 25940 - protein, 131 aa, Homo sapiens
  Payload ID: 5135
  Gene Symbol: DNM1
  Gene Name: dynamin 1
  ENSP ID: ENSP00000420808
  MOD_RES (1)..(1): Any amino acid
XELSGGARINRIFHERFPFELVKMEFDEKELRREISYAIKNIHGIRTGLFTPDLAFEATVKKQVQKLKEPSIKCVDMVVSELTATIRKCSEKLAEHPGNVQRQPEWKKMLKGDRTSQRGGGCPAMGDTWKT

SEQ ID NO: 25941 - protein, 835 aa, Homo sapiens
  Payload ID: 5135
  Gene Symbol: DNM1
  Gene Name: dynamin 1
  ENSP ID: ENSP00000486437
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDLAFEATVKKQLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPSRSGQASPSRPESPRPPFDL

SEQ ID NO: 25942 - protein, 864 aa, Homo sapiens
  Payload ID: 5135
  Gene Symbol: DNM1
  Gene Name: dynamin 1
  ENSP ID: ENSP00000486525
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPSRKGPASPTRPAAPRPAEAPLLDL

SEQ ID NO: 25943 - protein, 53 aa, Homo sapiens
  Payload ID: 5135
  Gene Symbol: DNM1
  Gene Name: dynamin 1
  ENSP ID: ENSP00000486770
  MOD_RES (1)..(1): Any amino acid
XPGPPPAGSALGGAPPVPSRPGASPDPFGPPPQVPSRPNRAPPGVPRITISDP

SEQ ID NO: 25944 - protein, 851 aa, Homo sapiens; identical to SEQ ID NO: 25935
  Payload ID: 5135
  Gene Symbol: DNM1
  Gene Name: dynamin 1
  Uniprot ID: Q05193
  ENSP ID: ENSP00000487310

SEQ ID NO: 25945 - protein, 856 aa, Homo sapiens
  Payload ID: 5135
  Gene Symbol: DNM1
  Gene Name: dynamin 1
  ENSP ID: ENSP00000489096
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPSQPIGSGKSIPS

SEQ ID NO: 25946 - protein, 699 aa, Homo sapiens
  Payload ID: 5136
  Gene Symbol: DNM1L
  Gene Name: dynamin 1-like
  Uniprot ID: O00429
  ENSP ID: ENSP00000266481
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 25947 - protein, 712 aa, Homo sapiens
  Payload ID: 5136
  Gene Symbol: DNM1L
  Gene Name: dynamin 1-like
  ENSP ID: ENSP00000350948
MEALIPVINKLQDVFNTVGADIIQLPQIVVVGTQSSGKSSVLESLVGRDLLPRGTGIVTRRPLILQLVHVSQEDKRKTTGEENDPATWKNSRHLSKGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 25948 - protein, 738 aa, Homo sapiens
  Payload ID: 5136
  Gene Symbol: DNM1L
  Gene Name: dynamin 1-like
  Uniprot ID: O00429
  ENSP ID: ENSP00000370388
MEALIPVINKLQDVFNTVGADIIQLPQIVVVGTQSSGKSSVLESLVGRDLLPRGTGIVTRRPLILQLVHVSQEDKRKTTGEENDPATWKNSRHLSKGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 25949 - protein, 156 aa, Homo sapiens
  Payload ID: 5136
  Gene Symbol: DNM1L
  Gene Name: dynamin 1-like
  ENSP ID: ENSP00000390090
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVAEP

SEQ ID NO: 25950 - protein, 180 aa, Homo sapiens
  Payload ID: 5136
  Gene Symbol: DNM1L
  Gene Name: dynamin 1-like
  ENSP ID: ENSP00000396030
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKVPVGDQPKDIELQIRELILRFISNPNSIILAVTAANTDMATSEALKISREVDPDGAS

SEQ ID NO: 25951 - protein, 533 aa, Homo sapiens
  Payload ID: 5136
  Gene Symbol: DNM1L
  Gene Name: dynamin 1-like
  Uniprot ID: O00429
  ENSP ID: ENSP00000404160
MFHKKINGKQQEKKMTLLHGKTQDTFLKGWKQKNGVNFFTPKIRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKLIQDSRRETKNVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 25952 - protein, 710 aa, Homo sapiens
  Payload ID: 5136
  Gene Symbol: DNM1L
  Gene Name: dynamin 1-like
  Uniprot ID: O00429
  ENSP ID: ENSP00000415131
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKLIQDSRRETKNVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 25953 - protein, 168 aa, Homo sapiens
  Payload ID: 5136
  Gene Symbol: DNM1L
  Gene Name: dynamin 1-like
  ENSP ID: ENSP00000447013
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKGVSPEPIHLKIFSPNVVNLTLVDLPGMTKVPVGDQPKDIELQIRELILRFISNPNSIILAVTAANTDMA

SEQ ID NO: 25954 - protein, 261 aa, Homo sapiens
  Payload ID: 5136
  Gene Symbol: DNM1L
  Gene Name: dynamin 1-like
  ENSP ID: ENSP00000447788
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLN

SEQ ID NO: 25955 - protein, 172 aa, Homo sapiens
  Payload ID: 5136
  Gene Symbol: DNM1L
  Gene Name: dynamin 1-like
  ENSP ID: ENSP00000447845
MEALIPVINKLQDVFNTVGADIIQLPQIVVVGTQSSGKSSVLESLVGRDLLPRDPATWKNSRHLSKGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANT

SEQ ID NO: 25956 - protein, 54 aa, Homo sapiens
  Payload ID: 5136
  Gene Symbol: DNM1L
  Gene Name: dynamin 1-like
  ENSP ID: ENSP00000448105
SSGKSSVLESLVGRDLLPRGTGIVTRRPLILQLVHVSQEDKRKTTGEENALHGF

SEQ ID NO: 25957 - protein, 725 aa, Homo sapiens
  Payload ID: 5136
  Gene Symbol: DNM1L
  Gene Name: dynamin 1-like
  Uniprot ID: O00429
  ENSP ID: ENSP00000448610
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 25958 - protein, 48 aa, Homo sapiens
  Payload ID: 5136
  Gene Symbol: DNM1L
  Gene Name: dynamin 1-like
  ENSP ID: ENSP00000448802
  MOD_RES (1)..(1): Any amino acid
XHCSNYSTQELLRFPKLHDAIVEVVTCLLRKRLPVTNEMCIWVLGSGW

SEQ ID NO: 25959 - protein, 117 aa, Homo sapiens
  Payload ID: 5136
  Gene Symbol: DNM1L
  Gene Name: dynamin 1-like
  ENSP ID: ENSP00000448936
MEALIPVINKLQDVFNTVGADIIQLPQIVVVGTQSSGKSSVLESLVGRDLLPRGTGIVTRRPLILQLVHVSQEDKRKTTGEENDPATWKNSRHLSKGVEAEEWGKFLHTKNKEPARY

SEQ ID NO: 25960 - protein, 749 aa, Homo sapiens
  Payload ID: 5136
  Gene Symbol: DNM1L
  Gene Name: dynamin 1-like
  Uniprot ID: O00429
  ENSP ID: ENSP00000449089
MEALIPVINKLQDVFNTVGADIIQLPQIVVVGTQSSGKSSVLESLVGRDLLPRGTGIVTRRPLILQLVHVSQEDKRKTTGEENDPATWKNSRHLSKGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKLIQDSRRETKNVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 25961 - protein, 736 aa, Homo sapiens
  Payload ID: 5136
  Gene Symbol: DNM1L
  Gene Name: dynamin 1-like
  Uniprot ID: O00429
  ENSP ID: ENSP00000450399
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNKGVSPEPIHLKIFSPNVVNLTLVDLPGMTKVPVGDQPKDIELQIRELILRFISNPNSIILAVTAANTDMATSEALKISREVDPDGRRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTAKYIETSELCGGARICYIFHETFGRTLESVDPLGGLNTIDILTAIRNATGPRPALFVPEVSFELLVKRQIKRLEEPSLRCVELVHEEMQRIIQHCSNYSTQELLRFPKLHDAIVEVVTCLLRKRLPVTNEMVHNLVAIELAYINTKHPDFADACGLMNNNIEEQRRNRLARELPSAVSRDKSSKVPSALAPASQEPSPAASAEADGKLIQDSRRETKNVASGGGGVGDGVQEPTTGNWRGMLKTSKAEELLAEEKSKPIPIMPASPQKGHAVNLLDVPVPVARKLSAREQRDCEVIERLIKSYFLIVRKNIQDSVPKAVMHFLVNHVKDTLQSELVGQLYKSSLLDDLLTESEDMAQRRKEAADMLKALQGASQIIAEIRETHLW

SEQ ID NO: 25962 - protein, 97 aa, Homo sapiens
  Payload ID: 5136
  Gene Symbol: DNM1L
  Gene Name: dynamin 1-like
  ENSP ID: ENSP00000450401
MEALIPVINKLQDVFNTVGADIIQLPQIVVVGTQSSGKSSVLESLVGRDLLPRGTGIVTRRPLILQLVHVSQEDKRKTTGEENVPRENSLDPGGKSP

SEQ ID NO: 25963 - protein, 870 aa, Homo sapiens
  Payload ID: 5137
  Gene Symbol: DNM2
  Gene Name: dynamin 2
  Uniprot ID: P50570
  ENSP ID: ENSP00000347890
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 25964 - protein, 866 aa, Homo sapiens
  Payload ID: 5137
  Gene Symbol: DNM2
  Gene Name: dynamin 2
  Uniprot ID: P50570
  ENSP ID: ENSP00000352721
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 25965 - protein, 870 aa, Homo sapiens
  Payload ID: 5137
  Gene Symbol: DNM2
  Gene Name: dynamin 2
  Uniprot ID: P50570
  ENSP ID: ENSP00000373905
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDMAFEAIVKKQIVKLKEPSLKCVDLVVSELATVIKKCAEKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 25966 - protein, 866 aa, Homo sapiens
  Payload ID: 5137
  Gene Symbol: DNM2
  Gene Name: dynamin 2
  Uniprot ID: P50570
  ENSP ID: ENSP00000386192
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDMAFEAIVKKQIVKLKEPSLKCVDLVVSELATVIKKCAEKLSSYPRLREETERIVTTYIREREGRTKDQILLLIDIEQSYINTNHEDFIGFANAQQRSTQLNKKRAIPNQVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 25967 - protein, 289 aa, Homo sapiens
  Payload ID: 5137
  Gene Symbol: DNM2
  Gene Name: dynamin 2
  ENSP ID: ENSP00000466603
RAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDMAFEAIVKKQIVKLKEPSLKCVDLVVSELATVIKKCAEKLSSYPRLREETERIVTTYIREREGRTKDQILLLIDIEQSYINTNHEDFIGFANCYYTEQLVTCAQQRSTQLNKKRAIPNQVIRRGWLTINNI

SEQ ID NO: 25968 - protein, 169 aa, Homo sapiens
  Payload ID: 5137
  Gene Symbol: DNM2
  Gene Name: dynamin 2
  ENSP ID: ENSP00000466621
PVRIPPGIPPGVPRGYVGTGRLSWKKRLSVQTCSTATSSSTATLTADQKLTRSKLPSCRLRSRASKARSSVSIWMLRSSRVRMVSMDSYRAAGGEGSGLPPPIREQRPKKPGDTEGGCINPGRYSCKHRLVQAKFKSSPCHSLAVTMSNLINLSEPVSSSISFQIAVNI

SEQ ID NO: 25969 - protein, 137 aa, Homo sapiens
  Payload ID: 5137
  Gene Symbol: DNM2
  Gene Name: dynamin 2
  ENSP ID: ENSP00000466914
  MOD_RES (1)..(1): Any amino acid
XADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPR

SEQ ID NO: 25970 - protein, 50 aa, Homo sapiens
  Payload ID: 5137
  Gene Symbol: DNM2
  Gene Name: dynamin 2
  ENSP ID: ENSP00000467430
MILQFISRESSLILAVTPANMDLANSDALKLAKEVDPQGLRTIGVITKLD

SEQ ID NO: 25971 - protein, 869 aa, Homo sapiens
  Payload ID: 5137
  Gene Symbol: DNM2
  Gene Name: dynamin 2
  Uniprot ID: P50570
  ENSP ID: ENSP00000468734
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYQIKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKNFRPDDPTRKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPRRPPAAPSRPTIIRPAEPSLLD

SEQ ID NO: 25972 - protein, 869 aa, Homo sapiens
  Payload ID: 5138
  Gene Symbol: DNM3
  Gene Name: dynamin 3
  Uniprot ID: Q9UQ16
  ENSP ID: ENSP00000347457
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQGTNLPPSRQIVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPSRRPPPSPTRPTIIRPLESSLLD

SEQ ID NO: 25973 - protein, 859 aa, Homo sapiens
  Payload ID: 5138
  Gene Symbol: DNM3
  Gene Name: dynamin 3
  Uniprot ID: Q9UQ16
  ENSP ID: ENSP00000356705
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPSRRPPPSPTRPTIIRPLESSLLD

SEQ ID NO: 25974 - protein, 555 aa, Homo sapiens
  Payload ID: 5138
  Gene Symbol: DNM3
  Gene Name: dynamin 3
  Uniprot ID: Q9UQ16
  ENSP ID: ENSP00000356707
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDENI

SEQ ID NO: 25975 - protein, 221 aa, Homo sapiens
  Payload ID: 5138
  Gene Symbol: DNM3
  Gene Name: dynamin 3
  ENSP ID: ENSP00000429165
AENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPRRPPPAVPGRPS

SEQ ID NO: 25976 - protein, 445 aa, Homo sapiens
  Payload ID: 5138
  Gene Symbol: DNM3
  Gene Name: dynamin 3
  ENSP ID: ENSP00000429416
MNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEK

SEQ ID NO: 25977 - protein, 639 aa, Homo sapiens
  Payload ID: 5138
  Gene Symbol: DNM3
  Gene Name: dynamin 3
  ENSP ID: ENSP00000429701
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVVSWIYLLCKNYY

SEQ ID NO: 25978 - protein, 863 aa, Homo sapiens
  Payload ID: 5138
  Gene Symbol: DNM3
  Gene Name: dynamin 3
  Uniprot ID: Q9UQ16
  ENSP ID: ENSP00000486701
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVGNNKAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPSRRPPPSPTRPTIIRPLESSLLD

SEQ ID NO: 25979 - protein, 1577 aa, Homo sapiens
  Payload ID: 5139
  Gene Symbol: DNMBP
  Gene Name: dynamin binding protein
  Uniprot ID: Q6XZF7
  ENSP ID: ENSP00000315659
MEAGSVVRAIFDFCPSVSEELPLFVGDIIEVLAVVDEFWLLGKKEDVTGQFPSSFVEIVTIPSLKEGERLFVCICEFTSQELDNLPLHRGDLVILDGIPTAGWLQGRSCWGARGFFPSSCVRELCLSSQSRQWHSQSALFQIPEYSMGQARALMGLSAQLDEELDFREGDVITIIGVPEPGWFEGELEGRRGIFPEGFVELLGPLRTVDESVSSGNQDDCIVNGEVDTPVGEEEIGPDEDEEEPGTYGVALYRFQALEPNELDFEVGDKIRILATLEDGWLEGSLKGRTGIFPYRFVKLCPDTRVEETMALPQEGSLARIPETSLDCLENTLGVEEQRHETSDHEAEEPDCIISEAPTSPLGHLTSEYDTDRNSYQDEDTAGGPPRSPGVEWEMPLATDSPTSDPTEVVNGISSQPQVPFHPNLQKSQYYSTVGGSHPHSEQYPDLLPLEARTRDYASLPPKRMYSQLKTLQKPVLPLYRGSSVSASRVVKPRQSSPQLHNLASYTKKHHTSSVYSISERLEMKPGPQAQGLVMEAATHSQGDGSTDLDSKLTQQLIEFEKSLAGPGTEPDKILRHFSIMDFNSEKDIVRGSSKLITEQELPERRKALRPPPPRPCTPVSTSPHLLVDQNLKPAPPLVVRPSRPAPLPPSAQQRTNAVSPKLLSRHRPTCETLEKEGPGHMGRSLDQTSPCPLVLVRIEEMERDLDMYSRAQEELNLMLEEKQDESSRAETLEDLKFCESNIESLNMELQQLREMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 25980 - protein, 224 aa, Homo sapiens
  Payload ID: 5139
  Gene Symbol: DNMBP
  Gene Name: dynamin binding protein
  ENSP ID: ENSP00000409476
MPTLFKGVWGVVEHSRALGRFCPACLPSGPHLHTQPALGTAEMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMEL

SEQ ID NO: 25981 - protein, 823 aa, Homo sapiens
  Payload ID: 5139
  Gene Symbol: DNMBP
  Gene Name: dynamin binding protein
  Uniprot ID: Q6XZF7
  ENSP ID: ENSP00000443657
MTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 25982 - protein, 415 aa, Homo sapiens
  Payload ID: 5140
  Gene Symbol: DAW1
  Gene Name: dynein assembly factor with WDR repeat domains 1
  Uniprot ID: Q8N136
  ENSP ID: ENSP00000311899
MKLKSLLLRYYPPGIMLEYEKHGELKTKSIDLLDLGPSTDVSALVEEIQKAEPLLTASRTEQVKLLIQRLQEKLGQNSNHTFYLFKVLKAHILPLTNVALNKSGSCFITGSYDRTCKLWDTASGEELNTLEGHRNVVYAIAFNNPYGDKIATGSFDKTCKLWSVETGKCYHTFRGHTAEIVCLSFNPQSTLVATGSMDTTAKLWDIQNGEEVYTLRGHSAEIISLSFNTSGDRIITGSFDHTVVVWDADTGRKVNILIGHCAEISSASFNWDCSLILTGSMDKTCKLWDATNGKCVATLTGHDDEILDSCFDYTGKLIATASADGTARIFSAATRKCIAKLEGHEGEISKISFNPQGNHLLTGSSDKTARIWDAQTGQCLQVLEGHTDEIFSCAFNYKGNIVITGSKDNTCRIWR

SEQ ID NO: 25983 - protein, 369 aa, Homo sapiens
  Payload ID: 5140
  Gene Symbol: DAW1
  Gene Name: dynein assembly factor with WDR repeat domains 1
  ENSP ID: ENSP00000362770
MKLKSLLLRYYPPGIMLEYEKHGELKTKSIDLLDLGPSTDVSALVEEIQKAEPLLTASRTEQVKLLIQRLQEKLGQNSNHTFYLFKVLKAHILPLTNVALNKSGSCFITGSYDRTCKLWDTASGEELNTLEGHRNVVYAIAFNNPYGDKIATGSFDKTCKLWSVETGKCYHTFRGHTAEIVCLSFNPQSTLVATGSMDTTAKLWDIQNGEEVYTLRGHSAEIISLSFNTSGDRIITGSFDHTVVVWDADTGRKVNILIGHCAEISSASFNWDCSLILTGSMDKTCKLWDATNGKCVATLTGHDDEILDSCFDYTGKLIATASADDGVSLCRPGWSAVARSWLTATCASQVQAILLPQPPELCHVLGNHV

SEQ ID NO: 25984 - protein, 71 aa, Homo sapiens
  Payload ID: 5140
  Gene Symbol: DAW1
  Gene Name: dynein assembly factor with WDR repeat domains 1
  ENSP ID: ENSP00000394853
MLEYEKHGELKTKSIDLLDLGPSTDVSALVEEIQKAEPLLTASRTEQVKLLIQRLQEKLGQNSNHTFYLFK

SEQ ID NO: 25985 - protein, 36 aa, Homo sapiens
  Payload ID: 5140
  Gene Symbol: DAW1
  Gene Name: dynein assembly factor with WDR repeat domains 1
  ENSP ID: ENSP00000403670
MKLKSLLLRYYPPVFGEPNHMQVSKILLNSRNYVGI

SEQ ID NO: 25986 - protein, 4753 aa, Homo sapiens
  Payload ID: 5141
  Gene Symbol: DNHD1
  Gene Name: dynein heavy chain domain 1
  Uniprot ID: Q96M86
  ENSP ID: ENSP00000254579
MVPEERRVGLSSDETSSDSLKSWHSICVLDSKEQPLACQQKQRQFVKPVTESEQPTVLELLLAELRTLFSAVLQDSSPAAWRYLHAVLGLLPPYRELLVGHLDLLPFLEQLYCWAPWVQTHLHLDLLGAIVQAFPPDSSLLDSASHADCCPQKRRLHHRPPCPACPFVQAQWSRQQVKEELATWLRPLTLPELQRCLGIVGAQVALEEAVWLDGLSLLPLALAADIPVRYESSDTDNAEVEPVGRKETRSQLDYEVPREKAFQKSSTGFSPETSFLDSQVMTALKMERYLKKIHFLYLNVAPSRYFRPYSLMVVPPDKVNPEHYIFSPFGILHVHPVEGSETMTLGTWHHHCVLWQQLQFIPFFKYCLLRKSFTCWKKNVRLQGLHRLQKFLENHLLLAVPHFGAGLLHISRLLQELHSVSWLPQELDRCYELLDLQTALAEEKHKALRLLHRCLNLCTSILRLVHEDTYHMQQCLQERVQNCDRIRTGQGSIYLQRVQHKQLEQKLKQAEAWWLQLGKFARLVDYMICQSLISVLEEQITSFVANILQAPRQKPFLSSQLVFDDHGQLSHVPCVENMIQTLTGGLQSVKTSALQVVQSADLKTSSDSLYSEEEDEEEDSKDEFLMPKFQGQPSDAVSIFCGPNVGLVWPWKSHPIAGILEVRGCRLRGQYFPHNYKQLEEDLDNNPKIQQALNIQQVLLEGVLCKVQEFCREHHWITGIYEFLQSWGPQKLEDMRGGPIKNYVTLVSRLNVWQARVSSMPIELLTKGGLLLLSCHDVQAEMESKLNSIRKDILAHVQNECWNLSQQLMTELTDFMHIFRTINSDIHAIAQCTQKLNEANEQYVELEERMEYVRALHELIRNHFSLFSAENEALDISVRRQFGESPIPPCPPPPQPHLLHCPLLAPQLLDMWEAFQFEKSQASEFLLSKRHAIMPKLQQLMAAALAELEGLLAKALSGPFMDPTQDQRSTEHQLVSLERQFQNTVSDLSELHHAYAIFTEDETPVPLPICGTRPIVQQQRIWHLYRVISENISEWKCMAFAKFSPAMAQEKTEGWLTEAARMSTTLELHSPVLQHCMRILGEFRSYLPLLTKLGSLHPQSLNCQCLLRALGLGSLQTIELLTLGQLLTYPLLEFADRINQVWQNENERIHAQETIRRLQRYWEARQLRLLNFILHVPYEPPASERSKRQVLRSPQWEVVDKDSGTFILSDYSNLQDSIQESLQVLSKILAIEKSGDLNKIALEWVAIMHGLGALLEVWLTFQQKWIFLNKVLHEMKIQFPNADLNSRFKVMDDQYRTLMRISVADPMVLSLVVPSAERSPYFQGQQLQQLLQAGSVELEGIIMSLESVLYGVCAHFPRLFFLSDSELVALLAARLESCEAQLWVRRCFPHVHAVSFRSCPTGEKNTDDWESSPNTQTQVEALAVLGAGGEEVKLQGPLPLHPDLPKWLASLEKCLRLALVHMLQGCVAARLARGPSLGEALKQLPKQNKLYLQLYVQHWIDLVQAFPWQCVLVAEEVVWRAEMEEALLEWGTLAMVSMHMRKLEVLVNFMRAQRASQGGQSLPSVRQTSLLSALLVMAVTHRDIAQLLEQHQVSDLTDFHWVRQLKYHLGSPHIIPKSPLQSLKTIASSEPSLSPAACWIDVLGRSFLYNYEYLGPRLGPLPSLLPERPALVLLLALEEVACGTVLGPNGVGKRAIVNSLAQALGRQLVMLPCSPQIEAQCLSNYLNGALQGGAWLLLEKVHQLPPGLLSALGQRLGELHHLYAPLYQEASRNTSTIDPTQPQLLGSSFFEKHHVSVRLGYGCLLVLRALSSAVPANLHLLLRPVALALPDLRQVAELTLLGAGMRDAFQMATRLSKFFSLERELVSGPLPCRLPLLKQILEDTIRTLNVTKEEPKCQKPRSLAAIEEAALLRSPLFSILNGLHLHNLRGLLCALFPSASQVLAEPMTYKLMKPLVVEELQQVGLDPSPDILGSLEQLSQALSRASGILLLGPAGSGKTTCWHSLFKIQNRLAAMEDTSTQGCQPVEITHLYPSGLSPQEFLGWLEGSCWHHGIFPKVLRAAGQCNNMGQKRQTEESIGIQHWIICDGASNGAWLDSITCLLSELPQLSLPSGQQIARPPGTFLLMEVADTTGISPTVVGCCALVWCGGEQTWQCILSALMASLPYEYRLQHRTVAELNHMAEVLVPATLRFLTCQGVSSLLQVHGQQAVCAGVAEVTSMARILHSLLDLHLRLKEEKAPGPEDLSYSDPVAQSFRSSKSSFLNRSQVDSDDVPDKCREHLLAVSSFLFALIWGFGAHLPSRFWPIFDTFIRDSISRLSNYPEPPPSALVFDLHVSPEDGTLVPFTGQYLSSHIKGTLGTFHPSIQTERLLYVVDLLLSGGQPVLLAGEAATGKSAFVEVLVEPHHPYIYSPIHPAFSSSHLRLLLSRGIQGQTQASPQPGHHQDSKPSLLFLLEDLHLATSDPEKSCQPVLETLRQAMDGTVYAHSTLELQTLQPTVNFLATVTVPGYCERPLCPRLFRLFTVLALESMTQATLLERHVPIIQAWLERFPSVERERALARGLVRASVEAWEAVCNCFMPSPLHPHYHFSLHSVSHLLSSLQLLPNRTGSRGFVDYPNHQEHLRRVSGLRGTCLTVMMATRNVVRLWLHEAQRTFCDRLDSPRERSYCAKLLLVVAQSVFCCGPGPQHLGKDHQESEEEEEEERVPEVESEGELAQWEDFSNSNSETEEEEEPYGLQVARVSNSRDPSLTPSIGPVSRGMKESISHKIRQEKGTRASNYRLQVRRSFKTWWQKKPQMDLISPLLLPVLLLHPQEKPSDLVFSQELILGPNSETPNLYLERQWEKLEEQLATSAAQLKLSPHLARCHSMAQHVARLVRVLARPRQHGLLLSGALGTGRHTAITLASSICQAHFFHLPSGSEEAILQCLRDASWHAGMLSQPVALLVPSGVDLTTLHRLLALATSGSFPGQYTEADLDRIGEHLPRENLGVKQNIKKEMVLQRFHQQVCSHLHLFFLIGDKQAHKQLPSTLFLRLLQLATASIDRYEPWDQAALAKVAQHHLEGAQSVPLDDGSWKYPDLQASIPSVAKAMALIHLSATHYHEHLCPALPLVTPKTFLDFLDTFLMLQQQTILKIKNKAQRVQNALENLRMLIKEHGTHANLIFDLEQQLKDSGKSLSMFQQQLEQSKLLYKQQLEECRHQENLIENLARQRDALQAQREAFLEQMSKAFLEPLSQLQVADFEEIRSYRAPPESVVRVTDAMCDLFHHETGWASAKQLLCTEDFYQELVFFPKEKITDSELIKLHLILKAPGMDDAALRAVSRPAASLAAWLWAVLHYGLAHCRGLPTDLLLQQVEATLTREQARLGYYQFQAQETLEHNLALAKMVEDAQASHNCVAKTLSQAQCGQYHKWPMKAALLTPMRAWTTQLQKLKGRCMTVFGDTLLCSAAIIYLGPFPPLRRQELLDEWLALCRGFQEALGPDDVAQALKRKQKSVSIPPKNPLLATHSPFSILSLLSSESEQYQWDGNLKPQAKSAHLAGLLLRSPTHYSSCRWPLLLDPSNEALIWLDPLPLEENRSFAPALTEGRGKGLMRNQKRESKTDMKEEDDESEESNEAEDQTKEQKAEERKNEQEKEQEENEEKEEEKTESQGSKPAYETQLPSLPYLSVLSGADPELGSQLQEAAACGLPVLLTNVELGLGCEELQWLLQREQLSPPQVQPGFCLYLSTTLSLCAMEKVLGCELLKGLNVLDLGLNMEILEEQMLHEILCREYPELETRWQDLKIRALDTCKAVEAAEERLLTMLLFQNPKRQKPAKFLRNIVRAQGKLCQLRAHCEELEGQKLQEMVLWAPYRPVVWHGMAMVKALSQLQNLLPLFCMSPENWLAVTKQALDSMKPREINHGEDLASHLLQLRAHLTRQLLGSTVTALGLTQVPLVGALGALALLQATGKASELERLALWPGLAASPSTVHSKPVSDVARPAWLGPKAWHECEMLELLPPFVGLCASLAGHSSAWQAYLSLSSTVLGPAPGPGPEPLSLLQKLILWRVLRPECLAGALADFTTSLLGRPLDENTYAPTMPFKHSQATQPMLILLPPPGHPSATLHPLTVIQKLAAKYQQGQKQLQVIALGSEAWDPVSVVVSTLSQAMYEGHWLVLDNCHLMPHWPKELLQLLLELLGRAKVVADLESEQLLDQPESRNVSTVHRDFRLWLIVPAESSASLPAVLTQHSMPVFWNQSLELGHVLIDSVELAQQVLYMQPPTQALPLLLLHGLLLHRQLYGTRLQAHRGRWSQVTLTQVLQTQDQLWASLSNPRAAMQELAASVFYGGPLGDTEDREALISLTQACLSPSSGSWVQPHTPQSLLATLMPLPELRELDAMAECKAQMHLLPSPPEPRLCGLSEGPQAWLLRRQSRALLSALQRSSPVWVPESRRGAQLAERRLRQRLVQVNRRLESLQDLLTHVIRQDESDAPWSVLGPNARRPLEGVLETEALELSQLVGTLQRDLDCLLQQLKGAPPCPSRRCAAVAHALWTGRLPLPWRPHAPAGPQPPWHWLRQLSRRGQLLVRYLGVGADASSDVPERVFHLSAFRHPRRLLLALRGEAALDQNVPSSNFPGSRGSVSSQLQYKRLEMNSNPLHFRVENGPNPTVPERGLLLIGLQVLHAEWDPIAGALQDSPSSQPSPLPPVSISTQAPGTSDLPAPADLTVYSCPVYMGGPLGTAKLQSRNIVMHLPLPTKLTPNTCVQRRVHVCSPPLS

SEQ ID NO: 25987 - protein, 597 aa, Homo sapiens
  Payload ID: 5141
  Gene Symbol: DNHD1
  Gene Name: dynein heavy chain domain 1
  Uniprot ID: Q96M86
  ENSP ID: ENSP00000346716
MVPEERRVGLSSDETSSDSLKSWHSICVLDSKEQPLACQQKQRQFVKPVTESEQPTVLELLLAELRTLFSAVLQDSSPAAWRYLHAVLGLLPPYRELLVGHLDLLPFLEQLYCWAPWVQTHLHLDLLGAIVQAFPPDSSLLDSASHADCCPQKRRLHHRPPCPACPFVQAQWSRQQVKEELATWLRPLTLPELQRCLGIVGAQVALEEAVWLDGLSLLPLALAADIPVRYESSDTDNAEVEPVGRKETRSQLDYEVPREKAFQKSSTGFSPETSFLDSQVMTALKMERYLKKIHFLYLNVAPSRYFRPYSLMVVPPDKVNPEHYIFSPFGILHVHPVEGSETMTLGTWHHHCVLWQQLQFIPFFKYCLLRKSFTCWKKNVRLQGLHRLQKFLENHLLLAVPHFGAGLLHISRLLQELHSVSWLPQELDRCYELLDLQTALAEEKHKALRLLHRCLNLCTSILRLVHEDTYHMQQCLQERVQNCDRIRTGQGSIYLQRVQHKQLEQKLKQAEAWWLQLGKFARLVDYMICQSLISVLEEQITSFVANILQAPRQKPFLSSQLVFDDHGQLSHVPCVENMIQTLTGGLQSVKTSALQVF

SEQ ID NO: 25988 - protein, 360 aa, Homo sapiens
  Payload ID: 5141
  Gene Symbol: DNHD1
  Gene Name: dynein heavy chain domain 1
  ENSP ID: ENSP00000433105
  MOD_RES (1)..(1): Any amino acid
XEAILQCLRDASWHAGMLSQPVALLVPSGVDLTTLHRLLALATSGSFPGQYTEADLDRIGEHLPRENLGVKQNIKKEMVLQRFHQQVCSHLHLFFLIGDKQAHKQLPSTLFLRLLQLATASIDRYEPWDQAALAKVAQHHLEGAQSVPLDDGSWKYPDLQASIPSVAKAMALIHLSATHYHEHLCPALPLVTPKTFLDFLDTFLMLQQQTILKIKNKAQRVQNALENLRMLIKEHGTHANLIFDLEQQLKDSGKSLSMFQQQLEQSKLLYKQQLEECRHQENLIENLARQRDALQAQREAFLEQVGSSCRLPCTAPLSKEGNPSKDTKRRGWSDSSWNLLGGGDKDEQGISGASEPAAGG

SEQ ID NO: 25989 - protein, 158 aa, Homo sapiens
  Payload ID: 5141
  Gene Symbol: DNHD1
  Gene Name: dynein heavy chain domain 1
  ENSP ID: ENSP00000435493
FEKSQASEFLLSKRHAIMPKLQQLMAAALAELEGLLAKALSGPFMDPTQDQRSTEHQLVSLERQFQNTVSDLSELHHAYAIFTGTEDPCTLHYHSVIDPSTERMRLLCPCQSVGHVLLCSSSAYGTCTESSPKTSASGSAWLLPSSAQLWPRRRQRAG

SEQ ID NO: 25990 - protein, 4753 aa, Homo sapiens; identical to SEQ ID NO: 25986
  Payload ID: 5141
  Gene Symbol: DNHD1
  Gene Name: dynein heavy chain domain 1
  Uniprot ID: Q96M86
  ENSP ID: ENSP00000436180

SEQ ID NO: 25991 - protein, 195 aa, Homo sapiens
  Payload ID: 5141
  Gene Symbol: DNHD1
  Gene Name: dynein heavy chain domain 1
  ENSP ID: ENSP00000462936
KGLNVLDLGLNMEILEEQMLHEILCREYPELETRWQDLKIRALDTCKAVEAAENPKRQKPAKFLRNIVRAQGKLCQLRAHCEELEGQKLQEMVLWAPYRPVVWHGMAMVKALSQLQNLLPLFCMSPENWLAVTKQALDSMKPREINHGEDLASHLLQLRAHLTRQLLGSTVTALGLTQVPLVGALGALALLQATG

SEQ ID NO: 25992 - protein, 142 aa, Homo sapiens
  Payload ID: 5141
  Gene Symbol: DNHD1
  Gene Name: dynein heavy chain domain 1
  ENSP ID: ENSP00000464173
  MOD_RES (1)..(1): Any amino acid
XSLELGHVLIDSVELAQQVLYMQPPTQALPLLLLHGLLLHRQLYGTRLQAHRGRWSQVTLTQVLQTQDQLWASLSNPRAAMQELAGGEWSKSHGSRERAAADRATGPTCGVGPNSWSLAGQSFQPTQPSASRQHQHTGPGHQ

SEQ ID NO: 25993 - protein, 5 aa, Homo sapiens
  Payload ID: 5141
  Gene Symbol: DNHD1
  Gene Name: dynein heavy chain domain 1
  ENSP ID: ENSP00000464390
MVPEE

SEQ ID NO: 25994 - protein, 740 aa, Homo sapiens
  Payload ID: 5142
  Gene Symbol: DRC1
  Gene Name: dynein regulatory complex subunit 1
  Uniprot ID: Q96MC2
  ENSP ID: ENSP00000288710
MNPPGSLEALDPNVDEHLSTQILAPSVHSDNSQERIQARRLRIAARLEARRREALGEYLDGKKESEEDQSKSYKQKEESRLKLAKLLLCGTELVTNIQVAIDIREIHRRVEEEEIKRQRIEKLENEVKTSQDKFDEITSKWEEGKQKRIPQELWEMLNTQQLHCAGLLEDKNKLISELQQELKTKDDQYVKDLKKQSDDICLLLERMEEQVKNVMKTFREELYNIEKAFEVERQELLASNKKKWEQALQAHNAKELEYLNNRMKKVEDYEKQLNRQRIWDCEEYNMIKIKLEQDVQILEQQLQQRKAIYQLNQEKLEYNLQVLKKRDEESTVIKSQQKRKINRLHDILNNLRSKYAKQIKQFQEENQSLTSDYKRLVMQFKELQKAMRHFALIDDEKFWEIWLMNEEEAKDLIARAFDVDRIIHTHHLGLPWAAPDFWFLNNVGPISQQPQKSATQIVEEMLMRSEEEEAEEAAAEPESYLDLPKQISEKTTKRILMLLCDESGFLIESKLLSLLLPLEQNECYLLRLDAIFSALGIESEDDLYKLVNFFLKYRAHRLSSSLQIKPCSQASMEKASMEETSTRSELELAEQTEMEGEKEESLVEGEKEEEEETPPSPWVIHPNDVLKILEAFVMGLKKPRDSRAPLRVQKNVRDNSKDSEYWQALTTVIPSSKQNLWDALYTALEKYHLVLTQRAKLLLENSSLEQQNTELQALLQQYLNSKINSELQVPPTQVLRVPTK

SEQ ID NO: 25995 - protein, 120 aa, Homo sapiens
  Payload ID: 5142
  Gene Symbol: DRC1
  Gene Name: dynein regulatory complex subunit 1
  ENSP ID: ENSP00000414375
MNPPGSLEALDPNVDEHLSTQILAPSVHSDNSQERIQARRLRIAARLEARRREALGEYLDGKKESEEDQSKSYKQKEESRLKLAKLLLCGTELVTNIQVAIDIREIHRRVEEEEIKRQRS

SEQ ID NO: 25996 - protein, 523 aa, Homo sapiens
  Payload ID: 5143
  Gene Symbol: DRC3
  Gene Name: dynein regulatory complex subunit 3
  Uniprot ID: Q9H069
  ENSP ID: ENSP00000326870
MNQPCNSMEPRVMDDDMLKLAVGDQGPQEEAGQLAKQEGILFKDVLSLQLDFRNILRIDNLWQFENLRKLQLDNNIIEKIEGLENLAHLVWLDLSFNNIETIEGLDTLVNLEDLSLFNNRISKIDSLDALVKLQVLSLGNNRIDNMMNIIYLRRFKCLRTLSLSRNPISEAEDYKMFICAYLPDLMYLDYRRIDDHTKKLAEAKHQYSIDELKHQENLMQAQLEDEQAQREELEKHKTAFVEHLNGSFLFDSMYAEDSEGNNLSYLPGVGELLETYKDKFVIICVNIFEYGLKQQEKRKTELDTFSECVREAIQENQEQGKRKIAKFEEKHLSSLSAIREELELPNIEKMILECSADISELFDALMTLEMQLVEQLEETINMFERNIVDMVGLFIENVQSLMAQCRDLENHHHEKLLEISISTLEKIVEGDLDEDLPNDLRALFVDKDTIVNAVGASHDIHLLKIDNREDELVTRINSWCTRLIDRIHKDEIMRNRKRVKEINQYIDHMQSELDNLECGDILD

SEQ ID NO: 25997 - protein, 457 aa, Homo sapiens
  Payload ID: 5143
  Gene Symbol: DRC3
  Gene Name: dynein regulatory complex subunit 3
  Uniprot ID: Q9H069
  ENSP ID: ENSP00000382136
MNQPCNSMEPRVMDDDMLKLAVGDQGPQEEAGQLAKQEGILFKDVLSLQLDFRNILRIDNLWQFENLRKLQLDNNIIEKIEGLENLAHLVWLDLSFNNIETIEGLDTLVNLEDLSLFNNRISKIDSLDALVKLQVLSLGNNRIDNMMNIIYLRRFKCLRTLSLSRNPISEAEDYKMFICAYLPDLMYLDYRRIDDHTKKLAEAKHQYSIDELKHQENLMQAQLEDEQAQREELEKHKTAFVEHLNGSFLFDSMYAEDSEGNNLSYLPGVGELLETYKDKFVIICVNIFEYGLKQQEKRKTELDTFSECVREAIQENQEQGKRKIAKFEEKHLSSLSAIREELELPNIEKMILECSADISELFDALMTLEMQLVEQLEETINMFERNIVDMVGLFIENVQSLMAQCRDLENHHHEKLLEISISTLEKIVEGDLDEDLPNDLRAGRFQKFNYVEASGTF

SEQ ID NO: 25998 - protein, 523 aa, Homo sapiens; identical to SEQ ID NO: 25996
  Payload ID: 5143
  Gene Symbol: DRC3
  Gene Name: dynein regulatory complex subunit 3
  Uniprot ID: Q9H069
  ENSP ID: ENSP00000382140

SEQ ID NO: 25999 - protein, 131 aa, Homo sapiens
  Payload ID: 5143
  Gene Symbol: DRC3
  Gene Name: dynein regulatory complex subunit 3
  ENSP ID: ENSP00000461917
MNQPCNSMEPRVMDDDMLKLAVGDQGPQEEAGQLAKQEGILFKDVLSLQLDFRNILRIDNLWQFENLRKLQLDNNIIEKIEGLENLAHLVWLDLSFNNIETIEGLDTLVNLEDLSLFNNRISKIDSLDALV

SEQ ID NO: 26000 - protein, 67 aa, Homo sapiens
  Payload ID: 5143
  Gene Symbol: DRC3
  Gene Name: dynein regulatory complex subunit 3
  ENSP ID: ENSP00000462091
  MOD_RES (1)..(1): Any amino acid
XNLMQAQLEDEQAQREELEKHKTAFVEHLNGSFLFDSMYAEDSEGNNLSYLPGVVAWSPEDVVGTCH

SEQ ID NO: 26001 - protein, 457 aa, Homo sapiens; identical to SEQ ID NO: 25997
  Payload ID: 5143
  Gene Symbol: DRC3
  Gene Name: dynein regulatory complex subunit 3
  Uniprot ID: Q9H069
  ENSP ID: ENSP00000462661

SEQ ID NO: 26002 - protein, 77 aa, Homo sapiens
  Payload ID: 5143
  Gene Symbol: DRC3
  Gene Name: dynein regulatory complex subunit 3
  ENSP ID: ENSP00000464101
IIYLRRFKCLRTLSLSRNPISEAEDYKMFICAYLPDLMYLDYRRIDDHTASVSLSVSQPCETDSSSPQVSWKRGIEE

SEQ ID NO: 26003 - protein, 51 aa, Homo sapiens
  Payload ID: 5143
  Gene Symbol: DRC3
  Gene Name: dynein regulatory complex subunit 3
  ENSP ID: ENSP00000464150
MNQPCNSMEPRVMDDDMLKLAVGDQGPQEEAGQLAKQEGILFKDVLSLQLD

SEQ ID NO: 26004 - protein, 138 aa, Homo sapiens
  Payload ID: 5143
  Gene Symbol: DRC3
  Gene Name: dynein regulatory complex subunit 3
  ENSP ID: ENSP00000464224
MNQPCNSMEPRVMDDDMLKLAVGDQGPQEEAGQLAKQEGILFKDVLSLQLDFRNILRIDNLWQFENLRKLQLDNNIIEKIEGLENLAHLVWLDLSFNNIETIEGLDTLVNLEDLSLFNNRISKIDSLDALVKLQVLSL

SEQ ID NO: 26005 - protein, 102 aa, Homo sapiens
  Payload ID: 5143
  Gene Symbol: DRC3
  Gene Name: dynein regulatory complex subunit 3
  ENSP ID: ENSP00000464476
MNQPCNSMEPRVMDDDMLKLAVGDQGPQEEAGQLAKQEGILFKDVLSLQLDFRNILRIDNLWQFENLRKLQLDNNIIEKIEGLENLAHLVWLDLSFNNIETI

SEQ ID NO: 26006 - protein, 83 aa, Homo sapiens
  Payload ID: 5143
  Gene Symbol: DRC3
  Gene Name: dynein regulatory complex subunit 3
  ENSP ID: ENSP00000464676
MNQPCNSMEPRVMDDDMLKLAVGDQGPQEEAGQLAKQEGILFKDVLSLQLDFRRKTADEPKGEQDDGQEDSQEDILRIDNLWQ

SEQ ID NO: 26007 - protein, 57 aa, Homo sapiens
  Payload ID: 5143
  Gene Symbol: DRC3
  Gene Name: dynein regulatory complex subunit 3
  ENSP ID: ENSP00000465314
  MOD_RES (1)..(1): Any amino acid
XMAQCRDLENHHHEKLLEISISTLEKIVEGDLDEDLPNDLRAGRFQKFNYVEASGTF

SEQ ID NO: 26008 - protein, 809 aa, Homo sapiens
  Payload ID: 5144
  Gene Symbol: DRC7
  Gene Name: dynein regulatory complex subunit 7
  Uniprot ID: Q8IY82
  ENSP ID: ENSP00000338938
MEVLREKVEEEEEAEREEAAEWAEWARMEKMMRPVEVRKEEITLKQETLRDLEKKLSEIQITVSAELPAFTKDTIDISKLPISYKTNTPKEEHLLQVADNFSRQYSHLCPDRVPLFLHPLNECEVPKFVSTTLRPTLMPYPELYNWDSCAQFVSDFLTMVPLPDPLKPTIKKEEKVLPKKYTIKPPRDLCSRFEQEQEVKKQQEIRAQEKKRLREEEERLMEAEKAKPDALHGLRVHSWVLVLSGKREVPENFFIDPFTGHSYSTQDEHFLGIESLWNHKNYWINMQDCWNCCKDLIFDLGDPVRWEYMLLGTDKSQLSLTEEDDSGINDEDDVENLGKEDEDKSFDMPHSWVEQIEISPEAFETRCPNGKKVIQYKRAKLEKWAPYLNSNGLVSRLTTYEDLQCTNILEIKEWYQNREDMLELKHINKTTDLKTDYFKPGHPQALRVHSYKSMQPEMDRVIEFYETARVDGLMKREETPRTMTEYYQGRPDFLSYRHASFGPRVKKLTLSSAESNPRPIVKITERFFRNPAKPAEEDVAERVFLVAEERIQLRYHCREDHITASKREFLRRTEVDSKGNKIIMTPDMCISFEVEPMEHTKKLLYQYEAMMHLKREEKLSRHQVWESELEVLEILKLREEEEAAHTLTISIYDTKRNEKSKEYREAMERMMHEEHLRQVETQLDYLAPFLAQLPPGEKLTCWQAVRLKDECLSDFKQRLINKANLIQARFEKETQELQKKQQWYQENQVTLTPEDEDLYLSYCSQAMFRIRILEQRLNRHKELAPLKYLALEEKLYKDPRLGELQKIFA

SEQ ID NO: 26009 - protein, 874 aa, Homo sapiens
  Payload ID: 5144
  Gene Symbol: DRC7
  Gene Name: dynein regulatory complex subunit 7
  Uniprot ID: Q8IY82
  ENSP ID: ENSP00000353942
MEVLREKVEEEEEAEREEAAEWAEWARMEKMMRPVEVRKEEITLKQETLRDLEKKLSEIQITVSAELPAFTKDTIDISKLPISYKTNTPKEEHLLQVADNFSRQYSHLCPDRVPLFLHPLNECEVPKFVSTTLRPTLMPYPELYNWDSCAQFVSDFLTMVPLPDPLKPPSHLYSSTTVLKYQKGNCFDFSTLLCSMLIGSGYDAYCVNGYGSLDLCHMDLTREVCPLTVKPKETIKKEEKVLPKKYTIKPPRDLCSRFEQEQEVKKQQEIRAQEKKRLREEEERLMEAEKAKPDALHGLRVHSWVLVLSGKREVPENFFIDPFTGHSYSTQDEHFLGIESLWNHKNYWINMQDCWNCCKDLIFDLGDPVRWEYMLLGTDKSQLSLTEEDDSGINDEDDVENLGKEDEDKSFDMPHSWVEQIEISPEAFETRCPNGKKVIQYKRAKLEKWAPYLNSNGLVSRLTTYEDLQCTNILEIKEWYQNREDMLELKHINKTTDLKTDYFKPGHPQALRVHSYKSMQPEMDRVIEFYETARVDGLMKREETPRTMTEYYQGRPDFLSYRHASFGPRVKKLTLSSAESNPRPIVKITERFFRNPAKPAEEDVAERVFLVAEERIQLRYHCREDHITASKREFLRRTEVDSKGNKIIMTPDMCISFEVEPMEHTKKLLYQYEAMMHLKREEKLSRHQVWESELEVLEILKLREEEEAAHTLTISIYDTKRNEKSKEYREAMERMMHEEHLRQVETQLDYLAPFLAQLPPGEKLTCWQAVRLKDECLSDFKQRLINKANLIQARFEKETQELQKKQQWYQENQVTLTPEDEDLYLSYCSQAMFRIRILEQRLNRHKELAPLKYLALEEKLYKDPRLGELQKIFA

SEQ ID NO: 26010 - protein, 874 aa, Homo sapiens; identical to SEQ ID NO: 26009
  Payload ID: 5144
  Gene Symbol: DRC7
  Gene Name: dynein regulatory complex subunit 7
  Uniprot ID: Q8IY82
  ENSP ID: ENSP00000377869

SEQ ID NO: 26011 - protein, 70 aa, Homo sapiens
  Payload ID: 5144
  Gene Symbol: DRC7
  Gene Name: dynein regulatory complex subunit 7
  ENSP ID: ENSP00000454722
MEVLREKVEEEEEAEREEAAEWAEWARMEKMMRPVEVRKEEITLKQETLRDLEKKLSEIQITVSAELPSS

SEQ ID NO: 26012 - protein, 53 aa, Homo sapiens
  Payload ID: 5144
  Gene Symbol: DRC7
  Gene Name: dynein regulatory complex subunit 7
  ENSP ID: ENSP00000455994
MPYPELYNWDSCAQFVSDFLTMVPLPDPLKPPSHLYSSTTVLKYQKGNCFDFS

SEQ ID NO: 26013 - protein, 427 aa, Homo sapiens
  Payload ID: 5144
  Gene Symbol: DRC7
  Gene Name: dynein regulatory complex subunit 7
  ENSP ID: ENSP00000456323
  MOD_RES (1)..(1): Any amino acid
XDMPHSWVEQIEISPEAFETRCPNGKKVIQYKRAKLEKWAPYLNSNGLVSRLTTYEDLQCTNILEIKEWYQNREDMLELKHINKTTDLKTDYFKPGHPQALRVHSYKSMQPEMDRVIEFYETARVDGLMKREETPRTMTEYYQGRPDFLSYRHASFGPRVKKLTLSSAESNPRPIVKITERFFRNPAKPAEEDVAERVFLVAEERIQLRYHCREDHITASKREFLRRTEVDSKGNKIIMTPDMCISFEVLEILKLREEEEAAHTLTISIYDTKRNEKSKEYREAMERMMHEEHLRQVETQLDYLAPFLAQLPPGEKLTCWQAVRLKDECLSDFKQRLINKANLIQARFEKETQELQKKQQWYQENQVTLTPEDEDLYLSYCSQAMFRIRILEQRLNRHKELAPLKYLALEEKLYKDPRLGELQKIFA

SEQ ID NO: 26014 - protein, 159 aa, Homo sapiens
  Payload ID: 5144
  Gene Symbol: DRC7
  Gene Name: dynein regulatory complex subunit 7
  ENSP ID: ENSP00000456374
  MOD_RES (1)..(1): Any amino acid
XKYTIKPPRDLCSRFEQEQEVKKQQEIRAQEKKRLREEEERLMEAEKAKPDALHGLRVHSWVLVLSGKREVPENFFIDPFTGHSYSTQDEHFLGIESLWNHKNYWINMQDCWNCCKVPREGELGGCGRHSAGDRNRGKQWQPDLGESETPGHEGFEPSP

SEQ ID NO: 26015 - protein, 94 aa, Homo sapiens
  Payload ID: 5144
  Gene Symbol: DRC7
  Gene Name: dynein regulatory complex subunit 7
  ENSP ID: ENSP00000456441
MEVLREKVEEEEEAEREEAAEWAEWARMEKMMRPVEVRKEEITLKQETLRDLEKKLSEIQITVSAELPAFTKDTIDISKLPISYKTNTPKEEHL

SEQ ID NO: 26016 - protein, 170 aa, Homo sapiens
  Payload ID: 5144
  Gene Symbol: DRC7
  Gene Name: dynein regulatory complex subunit 7
  ENSP ID: ENSP00000457676
MEVLREKVEEEEEAEREEAAEWAEWARMEKMMRPVEVRKEEITLKQETLRDLEKKLSEIQITVSAELPAFTKDTIDISKLPISYKTNTPKEEHLLQVADNFSRQYSHLCPDRVPLFLHPLNECEVPVRLKFVSTTLRPTLMPYPELYNWDSCAQFVSDFLTMVPLPDPLK

SEQ ID NO: 26017 - protein, 725 aa, Homo sapiens
  Payload ID: 5145
  Gene Symbol: DNAAF1
  Gene Name: dynein, axonemal, assembly factor 1
  Uniprot ID: Q8NEP3
  ENSP ID: ENSP00000367815
MHPEPSEPATGGAAELDCAQEPGVEESAGDHGSAGRGGCKEEINDPKEICVGSSDTSYHSQQKQSGDNGSGGHFAHPREDREDRGPRMTKSSLQKLCKQHKLYITPALNDTLYLHFKGFDRIENLEEYTGLRCLWLQSNGIQKIENLEAQTELRCLFLQMNLLRKIENLEPLQKLDALNLSNNYIKTIENLSCLPVLNTLQMAHNHLETVEDIQHLQECLRLCVLDLSHNKLSDPEILSILESMPDLRVLNLMGNPVIRQIPNYRRTVTVRLKHLTYLDDRPVFPKDRACAEAWARGGYAAEKEERQQWESRERKKITDSIEALAMIKQRAEERKRQRESQERGEMTSSDDGENVPASAEGKEEPPGDRETRQKMELFVKESFEAKDELCPEKPSGEEPPVEAKREDGGPEPEGTLPAETLLLSSPVEVKGEDGDGEPEGTLPAEAPPPPPPVEVKGEDGDQEPEGTLPAETLLLSPPVKVKGEDGDREPEGTLPAEAPPPPPLGAAREEPTPQAVATEGVFVTELDGTRTEDLETIRLETKETFCIDDLPDLEDDDETGKSLEDQNMCFPKIEVISSLSDDSDPELDYTSLPVLENLPTDTLSNIFAVSKDTSKAARVPFTDIFKKEAKRDLEIRKQDTKSPRPLIQELSDEDPSGQLLMPPTCQRDAAPLTSSGDRDSDFLAASSPVPTESAATPPETCVGVAQPSQALPTWDLTAFPAPKAS

SEQ ID NO: 26018 - protein, 190 aa, Homo sapiens
  Payload ID: 5145
  Gene Symbol: DNAAF1
  Gene Name: dynein, axonemal, assembly factor 1
  ENSP ID: ENSP00000454960
NMCFPKIEVISSLSDDSDPELDYTSLPVLENLPTDTLSNIFAVSKDTSKAARVPFTDIFKKEAKRDLEIRKQDTKSPRPLIQELSDEDPSGQLLMPPTCQRDAAPLTSSGDRDSDFLAASSPEMGFHHVDQAGLELLTSGDLFASASQSAGITVPTESAATPPETCVGVAQPSQALPTWDLTAFPAPKAS

SEQ ID NO: 26019 - protein, 247 aa, Homo sapiens
  Payload ID: 5145
  Gene Symbol: DNAAF1
  Gene Name: dynein, axonemal, assembly factor 1
  ENSP ID: ENSP00000455154
MHPEPSEPATGGAAELDCAQEPGVEESAGDHGSAGRGGCKEEINDPKEICVGSSDTSYHSQQKQSGDNGSGGHFAHPREDREDRGPRMTKSSLQKLCKQHKLYITPALNDTLYLHFKGFDRIENLEEYTGLRCLWLQSNGIQKIENLEAQTELRCLFLQMNLLRKIENLEPLQKLDALNLSNNYIKTIENLSCLPVLNTLQMAHNHLETVEDIQHLQECLRLCVLDLSHNKLSDPEILSILESMPDL

SEQ ID NO: 26020 - protein, 418 aa, Homo sapiens
  Payload ID: 5145
  Gene Symbol: DNAAF1
  Gene Name: dynein, axonemal, assembly factor 1
  Uniprot ID: Q8NEP3
  ENSP ID: ENSP00000457373
MHPEPSEPATGGAAELDCAQEPGVEESAGDHGSAGRGGCKEEINDPKEICVGSSDTSYHSQQKQSGDNGSGGHFAHPREDREDRGPRMTKSSLQKLCKQHKLYITPALNDTLYLHFKGFDRIENLEEYTGLRCLWLQSNGIQKIENLEAQTELRCLFLQMNLLRKIENLEPLQKLDALNLSNNYIKTIENLSCLPVLNTLQMAHNHLETVEDIQHLQECLRLCVLDLSHNKLSDPEILSILESMPDLRVLNLMGNPVIRQIPNYRRTVTVRLKHLTYLDDRPVFPKDRACAEAWARGGYAAEKEERQQWESRERKKITDSIEALAMIKQRAEERKRQRESQERGEMTSSDDGENVPASAEGKEEPPGDRETRQKMELFVKESFEAKDELCPEKPSGEEPPVEAKREDGDPATVTACEG

SEQ ID NO: 26021 - protein, 58 aa, Homo sapiens
  Payload ID: 5145
  Gene Symbol: DNAAF1
  Gene Name: dynein, axonemal, assembly factor 1
  ENSP ID: ENSP00000457899
  MOD_RES (1)..(1): Any amino acid
XKQDTKSPRPLIQELSDEDPSGQLLMPPTCQRDAAPLTSSGDRDSDFLAASSPAAKCI

SEQ ID NO: 26022 - protein, 837 aa, Homo sapiens
  Payload ID: 5146
  Gene Symbol: DNAAF2
  Gene Name: dynein, axonemal, assembly factor 2
  Uniprot ID: Q9NVR5
  ENSP ID: ENSP00000298292
MAKAAASSSLEDLDLSGEEVQRLTSAFQDPEFRRMFSQYAEELTDPENRRRYEAEITALERERGVEVRFVHPEPGHVLRTSLDGARRCFVNVCSNALVGAPSSRPGSGGDRGAAPGSHWSLPYSLAPGREYAGRSSSRYMVYDVVFHPDALALARRHEGFRQMLDATALEAVEKQFGVKLDRRNAKTLKAKYKGTPEAAVLRTPLPGVIPARPDGEPKGPLPDFPYPYQYPAAPGPRAPSPPEAALQPAPTEPRYSVVQRHHVDLQDYRCSRDSAPSPVPHELVITIELPLLRSAEQAALEVTRKLLCLDSRKPDYRLRLSLPYPVDDGRGKAQFNKARRQLVVTLPVVLPAARREPAVAVAAAAPEESADRSGTDGQACASAREGEAGPARSRAEDGGHDTCVAGAAGSGVTTLGDPEVAPPPAAAGEERVPKPGEQDLSRHAGSPPGSVEEPSPGGENSPGGGGSPCLSSRSLAWGSSAGRESARGDSSVETREESEGTGGQRSACAMGGPGTKSGEPLCPPLLCNQDKETLTLLIQVPRIQPQSLQGDLNPLWYKLRFSAQDLVYSFFLQFAPENKLSTTEPVISISSNNAVIELAKSPESHGHWREWYYGVNNDSLEERLFVNEENVNEFLEEVLSSPFKQSMSLTPPLIEVLQVTDNKIQINAKLQECSNSDQLQGKEERVNEESHLTEKEYIEHCNTPTTDSDSSIAVKALQIDSFGLVTCFQQESLDVSQMILGKSQQPESKMQSEFIKEKSATCSNEEKDNLNESVITEEKETDGDHLSSLLNKTTVHNIPGFDSIKETNMQDGSVQVIKDHVTNCAFSFQNSLLYDLD

SEQ ID NO: 26023 - protein, 789 aa, Homo sapiens
  Payload ID: 5146
  Gene Symbol: DNAAF2
  Gene Name: dynein, axonemal, assembly factor 2
  Uniprot ID: Q9NVR5
  ENSP ID: ENSP00000384862
MAKAAASSSLEDLDLSGEEVQRLTSAFQDPEFRRMFSQYAEELTDPENRRRYEAEITALERERGVEVRFVHPEPGHVLRTSLDGARRCFVNVCSNALVGAPSSRPGSGGDRGAAPGSHWSLPYSLAPGREYAGRSSSRYMVYDVVFHPDALALARRHEGFRQMLDATALEAVEKQFGVKLDRRNAKTLKAKYKGTPEAAVLRTPLPGVIPARPDGEPKGPLPDFPYPYQYPAAPGPRAPSPPEAALQPAPTEPRYSVVQRHHVDLQDYRCSRDSAPSPVPHELVITIELPLLRSAEQAALEVTRKLLCLDSRKPDYRLRLSLPYPVDDGRGKAQFNKARRQLVVTLPVVLPAARREPAVAVAAAAPEESADRSGTDGQACASAREGEAGPARSRAEDGGHDTCVAGAAGSGVTTLGDPEVAPPPAAAGEERVPKPGEQDLSRHAGSPPGSVEEPSPGGENSPGGGGSPCLSSRSLAWGSSAGRESARGDSSVETREESEGTGGQRSACAMGGPGTKSGEPLCPPLLCNQDKETLTLLIQVPRIQPQSLQGDLNPLWYKLRFSAQDLVYSFFLQFAPENKLSTTEPVISISSNNAVIELAKSPESHGHWREWYYGVNNDSLELQECSNSDQLQGKEERVNEESHLTEKEYIEHCNTPTTDSDSSIAVKALQIDSFGLVTCFQQESLDVSQMILGKSQQPESKMQSEFIKEKSATCSNEEKDNLNESVITEEKETDGDHLSSLLNKTTVHNIPGFDSIKETNMQDGSVQVIKDHVTNCAFSFQNSLLYDLD

SEQ ID NO: 26024 - protein, 588 aa, Homo sapiens
  Payload ID: 5147
  Gene Symbol: DNAAF3
  Gene Name: dynein, axonemal, assembly factor 3
  ENSP ID: ENSP00000375600
MLPLLDSSKRAGTLGSGCGVPRVHSAALSREEGASRDIWRIKVWARVMTTPAGSGSGFGSVSWWGLSPALDLQAESPPVDPDSQADTVHSNPELDVLLLGSVDGRHLLRTLSRAKFWPRRRFNFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPQEFRRWRDTGVAFELRDSSAYHVPNRTLASGRLLSYRGERVAARGYWGDIATGPFVAFGIEADDESLLRTSNGQPVKTAGEITQHNVTELLRDVAAWGRARATGGDLEEQQHAEGSPEPGTPAAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 26025 - protein, 487 aa, Homo sapiens
  Payload ID: 5147
  Gene Symbol: DNAAF3
  Gene Name: dynein, axonemal, assembly factor 3
  ENSP ID: ENSP00000394343
MKMRAQIPESLREEGIEILKPQFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPQEFRRWRDTGVAFELRDSSAYHVPNRTLASGRLLSYRGERVAARGYWGDIATGPFVAFGIEADDESLLRTSNGQPVKTAGEITQHNVTELLRDVAAWGRARATGGDLEEQQHAEGSPEPGTPAAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 26026 - protein, 541 aa, Homo sapiens
  Payload ID: 5147
  Gene Symbol: DNAAF3
  Gene Name: dynein, axonemal, assembly factor 3
  ENSP ID: ENSP00000432046
MTTPAGSGSGFGSVSWWGLSPALDLQAESPPVDPDSQADTVHSNPELDVLLLGSVDGRHLLRTLSRAKFWPRRRFNFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPQEFRRWRDTGVAFELRDSSAYHVPNRTLASGRLLSYRGERVAARGYWGDIATGPFVAFGIEADDESLLRTSNGQPVKTAGEITQHNVTELLRDVAAWGRARATGGDLEEQQHAEGSPEPGTPAAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 26027 - protein, 112 aa, Homo sapiens
  Payload ID: 5147
  Gene Symbol: DNAAF3
  Gene Name: dynein, axonemal, assembly factor 3
  ENSP ID: ENSP00000432360
MVPQPAVILPGPPVDPDSQADTVHSNPELDVLLLGSVDGRHLLRTLSRAKFWPRRRFNFFVLENNLEAVARHMLIFSLALEEPEKMGLQERSETFLEVWGNALLRPPVAAFV

SEQ ID NO: 26028 - protein, 105 aa, Homo sapiens
  Payload ID: 5147
  Gene Symbol: DNAAF3
  Gene Name: dynein, axonemal, assembly factor 3
  ENSP ID: ENSP00000432838
MVPQPAVILPGPPVDPDSQADTVHSNPELDVLLLGSVDGRHLLRTLSRAKFWPRRRFNFFVLENNLEAVARHMLIFSLALEEPEKMGLQERSETFLEVWGNALLR

SEQ ID NO: 26029 - protein, 95 aa, Homo sapiens
  Payload ID: 5147
  Gene Symbol: DNAAF3
  Gene Name: dynein, axonemal, assembly factor 3
  Uniprot ID: Q8N9W5
  ENSP ID: ENSP00000433247
MTTPAGSGSGFGSVSWWGLSPALDLQAESPPVDPDSQADTVHSNPELDVLLLGSVDGRHLLRTLSRAKFWPRRRFNVSWDEDESPDSRVLEGGRD

SEQ ID NO: 26030 - protein, 95 aa, Homo sapiens; identical to SEQ ID NO: 26029
  Payload ID: 5147
  Gene Symbol: DNAAF3
  Gene Name: dynein, axonemal, assembly factor 3
  Uniprot ID: Q8N9W5
  ENSP ID: ENSP00000433826

SEQ ID NO: 26031 - protein, 608 aa, Homo sapiens
  Payload ID: 5147
  Gene Symbol: DNAAF3
  Gene Name: dynein, axonemal, assembly factor 3
  ENSP ID: ENSP00000436975
MLPLLDSSKRAGTLGSGCGVPRVHSAALSREEGASRDIWRIKVWARVMTTPAGSGSGFGSVSWWGLSPALDLQAERDATVDALPTTMVPQPAVILPGPPVDPDSQADTVHSNPELDVLLLGSVDGRHLLRTLSRAKFWPRRRFNFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPQEFRRWRDTGVAFELRDSSAYHVPNRTLASGRLLSYRGERVAARGYWGDIATGPFVAFGIEADDESLLRTSNGQPVKTAGEITQHNVTELLRDVAAWGRARATGGDLEEQQHAEGSPEPGTPAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 26032 - protein, 208 aa, Homo sapiens
  Payload ID: 5147
  Gene Symbol: DNAAF3
  Gene Name: dynein, axonemal, assembly factor 3
  ENSP ID: ENSP00000472645
  MOD_RES (1)..(1): Any amino acid
XLEEQQHAEGSPEPGTPAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 26033 - protein, 160 aa, Homo sapiens
  Payload ID: 5147
  Gene Symbol: DNAAF3
  Gene Name: dynein, axonemal, assembly factor 3
  ENSP ID: ENSP00000473009
MTTPAGSGSGFGSVSWWGLSPALDLQAESPPVDPDSQADTVHSNPELDVLLLGSVDGRHLLRTLSRAKFWPRRRFNFFVLENNLEAVARHMLIFSLALEEPEKMGLQERSETFLEVWGNALLRPPVAAFVRAQADLLAHLVPEPDRLEEQLPWLSLRALK

SEQ ID NO: 26034 - protein, 855 aa, Homo sapiens
  Payload ID: 5148
  Gene Symbol: DNAAF5
  Gene Name: dynein, axonemal, assembly factor 5
  Uniprot ID: Q86Y56
  ENSP ID: ENSP00000297440
MAALGVAEAVAAPHPAEGAETAEAVELSRALSRLLPGLEADSKPGRRRALEALRRALEEPGPAADPTAFQGPWARLLLPRLLRCLSDPAEGCRALAVHLLDLGLRRAARPRDALPRLLPALAARLAGPVPARRPPEACEELRLALVQLLGLAVDLCGAALAPHLDDALRALRCSLLDPFAAVRRESCSCAAALAQATPDHFHMQSESLIGPLMQTISHQHWKVRVAAIEATGAVIHFGNGKSVDDVLSHFAQRLFDDVPQVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTRSAELVGTFVSPEVFLKLILSTLKKTPSASGLLVLASAMRGCPREALQPHLAAIATELAQAHICQASENDLYLERLLLCVQALVSVCHEDCGVASLQLLDVLLTIVALAGATGLRDKAQETMDSLAMVEGVSSCQDLYRKHIGPLLERVTASHLDWTAHSPELLQFSVIVAQSGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 26035 - protein, 280 aa, Homo sapiens
  Payload ID: 5148
  Gene Symbol: DNAAF5
  Gene Name: dynein, axonemal, assembly factor 5
  ENSP ID: ENSP00000384884
MTGGAREKAHIARSPATAQGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 26036 - protein, 657 aa, Homo sapiens
  Payload ID: 5148
  Gene Symbol: DNAAF5
  Gene Name: dynein, axonemal, assembly factor 5
  ENSP ID: ENSP00000403165
  MOD_RES (1)..(1): Any amino acid
XSPPCAARAAAAPPPWRRPRPHWKVRVAAIEATGAVIHFGNGKSVDDVLSHFAQRLFDDVPQVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTRSAELVGTFVSPEVFLKLILSTLKKTPSASGLLVLASAMRGCPREALQPHLAAIATELAQAHICQASENDLYLERLLLCVQALVSVCHEDCGVASLQLLDVLLTIVALAGATGLRDKAQETMDSLAMVEGVSSCQDLYRKHIGPLLERVTASHLDWTAHSPELLQFSVIVAQSGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 26037 - protein, 195 aa, Homo sapiens
  Payload ID: 5148
  Gene Symbol: DNAAF5
  Gene Name: dynein, axonemal, assembly factor 5
  ENSP ID: ENSP00000410788
  MOD_RES (1)..(1): Any amino acid
XLCARCAAPCSTPSPPCAARAAAAPPPWRRPRPVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTR

SEQ ID NO: 26038 - protein, 4265 aa, Homo sapiens
  Payload ID: 5149
  Gene Symbol: DNAH1
  Gene Name: dynein, axonemal, heavy chain 1
  Uniprot ID: Q9P2D7
  ENSP ID: ENSP00000401514
MEQPNSKGYSLGRTPQGPECSSAPAVQVGTHRGLEYNPGKILPGSDYGLGNPPALDPKLPHLPLPPAPPTLSDLGQPRKSPLTGTDKKYPLMKQRGFYSDILSPGTLDQLGEVCRGPRMSQNLLRQADLDKFTPRVGSFEVPEDFQERMEQQCIGSTTRLLAQTDFPLQAYEPKMQVPFQVLPGQHPRKIEIERRKQQYLSLDIEQLLFSQGIDSNKLMPRHLDHQHPQTIEQGHDPIFPIYLPLKVFDNEDFDCRTPREWINMGLEPGSLDRKPVPGKALLPTDDFLGHEDPKSQKLKYKWCEVGVLDYDEEKKLYLVHKTDEKGLVRDEMGRPILNAGVTTEGRPPLQVCQYWVPRIQLLFCAEDPCMFAQRVVQANALRKNTEALLLYNLYVDCMPSDGQHVISEQSLSKIKQWALSTPRMRKGPSVLEHLSSLAREVSLDYERSMNKINFDHVVSSKPETFSYVTLPKKEEEQVPERGLVSVPKYHFWEQKEDFTFVSLLTRPEVITALSKVRAECNKVTAMSLFHSSLSKYSHLEEFEQIQSQTFSQVQMFLKDSWISSLKVAMRSSLRDMSKGWYNLYETNWEVYLMSKLRKLMELVKYMLQDTLRFLVQDSLASFSQFISDTCCSVLNCTDDMVWGDDLINSPYRPRKNPLFIMDLVLDSSGVHYSTPLEQFEASLLNLFDKGILATHAVPQLEKLVMEDIFISGDPLLESVGLHEPLVEELRATIASAVSKAMIPLQAYAKEYRKYLELNNNDIASFLKTYQTQGLLAQEVREVVLTHLREKEILDSSLPSSIIIGPFYINTDNVKQSLSKKRKALATSVLDILAKNLHKEVDSICEEFRSISRKIYEKPNSIEELAELREWMKGIPERLVGLEERIVKVMDDYQVMDEFLYNLSSDDFNDKWIASNWPSKILGQIELVQQQHVEDEEKFRKIQIMDQNNFQEKLEGLQLVVAGFSIHVEISRAHEIANEVRRVKKQLKDCQQLAMLYNNRERIFSLPITNYDKLSRMVKEFQPYLDLWTTASDWLRWSESWMNDPLSAIDAEQLEKNVVEAFKTMHKCVKQFKDMPACQEVALDIRARIEEFKPYIPLIQGLRNPGMRIRHWETLSNQININVRPKANLTFARCLEMNLQDHIESISKVAEVAGKEYAIEQALDKMEKEWSTILFNVLPYKATDTYILKSPDEASQLLDDHIVMTQNMSFSPYKKPFEQRINSWENKLKLTQEVLEEWLNCQRSWLYLEPIFSSEDINQQLPVESKRYQTMERIWKKIMKNAYENREVINVCSDLRMLDSLRDCNKILDLVQKGLSEYLETKRSAFPRFYFLSDDELLEILSQTKDPTAVQPHLRKCFENIARLLFQEDLEITHMYSAEGEEVQLCFSIYPSSNVEDWLREVERSMKASVHDIIEKAIRAYPTMPRTQWVLNWPGQVTIAGCQTYWTMEVAEALEAGNLRSQLFPQLCQQLSDLVALVRGKLSRMQRAVLSALIVIEVHAKDVVSKLIQENVVSVNDFQWISQLRYYWTNNDLYIRAVNAEFIYGYEYLGNSGRLVITPLTDRCYLTLTGALHLKFGGAPAGPAGTGKTETTKDLGKALAIQTVVFNCSDQLDFMAMGKFFKGLASAGAWACFDEFNRIDIEVLSVVAQQITTIQKAQQQRVERFMFEGVEIPLVPSCAVFITMNPGYAGRTELPDNLKALFRPVAMMVPDYAMITEISLYSFGFNEASVLAKKITTTFKLSSEQLSSQDHYDFGMRAVKTVISAAGNLKRENPSMNEELICLRAIRDVNVPKFLQEDLKLFSGIVSDLFPTIKEEDTDYGILDEAIREACRNSNLKDVEGFLTKCIQLYETTVVRHGLMLVGPTGSGKSTCYRVLAAAMTSLKGQPSISGGMYEAVNYYVLNPKSITMGQLYGEFDLLTHEWTDGIFSSFIRAGAITSDTNKKWYMFDGPVDAIWIENMNTVLDDNKKLCLSSGEIIKLTEAMTMMFEVQDLAVASPATVSRCGMVYLEPSILGLMPFIECWLRKLPPLLKPYEEHFKALFVSFLEESISFVRSSVKEVIASTNCNLTMSLLKLLDCFFKPFLPREGLKKIPSEKLSRIVELIEPWFIFSLIWSVGATGDSSGRTSFSHWLRLKMENEQLTLLFPEEGLVFDYRLEDAGISGTNDSEDEEEEYKQVAWVKWMDSSAPFTMVPDTNYCNIIVPTMDTVQMSHLLDMLLTNKKPVLCIGPTGTGKTLTISDKLLKNLALDYISHFLTFSARTSANQTQDFIDSKLDKRRKGVFGPPLGRNFIFFIDDLNMPALETYGAQPPIELLRQWMDHGGWYDRKIIGAFKNLVDINFVCAMGPPGGGRNTVTPRLMRHFNYLSFAEMDEVSKKRIFSTILGNWLDGLLGEKSYRERVPGAPHIAHFTEPLVEATIMVYATITSQLLPTPAKSHYTFNLRDLSKVFQGMLMADPAKVEDQVQLLRLWYHENCRVFRDRLVNEEDRSWFDQLLKRCMEQWEVTFNKVCPFQPILYGDFMSPGSDVKSYELITSESKMMQVIEEYIEDYNQINTAKLKLVLFMDAMSHICRISRTLRQALGNALLLGVGGSGRSSLTRLASHMAEYECFQIELSKNYGMSEWRDDVKKVLLKAGLQNLPITFLFSDTQIKNESFLEDINNVLNSGDIPNLYTADEQDQIVSTMRPYIQEQGLQPTKANLMAAYTGRVRSNIHMVLCMSPIGEVFRARLRQFPSLVNCCTIDWFNEWPAEALKSVATVFLNEIPELESSQEEIQGLIQVCVYIHQSVSKKCIEYLAELTRHNYVTPKSYLELLHIFSILIGQKKLELKTAKNRMKSGLDKLLRTSEDVAKMQEDLESMHPLLEEAAKDTMLTMEQIKVDTAIAEETRNSVQTEEIKANEKAKKAQAIADDAQKDLDEALPALDAALASLRNLNKNDVTEVRAMQRPPPGVKLVIEAVCIMKGIKPKKVPGEKPGTKVDDYWEPGKGLLQDPGHFLESLFKFDKDNIGDVVIKAIQPYIDNEEFQPATIAKVSKACTSICQWVRAMHKYHFVAKAVEPKRQALLEAQDDLGVTQRILDEAKQRLREVEDGIATMQAKYRECITKKEELELKCEQCEQRLGRAGKLINGLSDEKVRWQETVENLQYMLNNISGDVLVAAGFVAYLGPFTGQYRTVLYDSWVKQLRSHNVPHTSEPTLIGTLGNPVKIRSWQIAGLPNDTLSVENGVINQFSQRWTHFIDPQSQANKWIKNMEKDNGLDVFKLSDRDFLRSMENAIRFGKPCLLENVGEELDPALEPVLLKQTYKQQGNTVLKLGDTVIPYHEDFRMYITTKLPNPHYTPEISTKLTLINFTLSPSGLEDQLLGQVVAEERPDLEEAKNQLIISNAKMRQELKDIEDQILYRLSSSEGNPVDDMELIKVLEASKMKAAEIQAKVRIAEQTEKDIDLTRMEYIPVAIRTQILFFCVSDLANVDPMYQYSLEWFLNIFLSGIANSERADNLKKRISNINRYLTYSLYSNVCRSLFEKHKLMFAFLLCVRIMMNEGKINQSEWRYLLSGGSISIMTENPAPDWLSDRAWRDILALSNLPTFSSFSSDFVKHLSEFRVIFDSLEPHREPLPGIWDQYLDQFQKLLVLRCLRGDKVTNAMQDFVATNLEPRFIEPQTANLSVVFKDSNSTTPLIFVLSPGTDPAADLYKFAEEMKFSKKLSAISLGQGQGPRAEAMMRSSIERGKWVFFQNCHLAPSWMPALERLIEHINPDKVHRDFRLWLTSLPSNKFPVSILQNGSKMTIEPPRGVRANLLKSYSSLGEDFLNSCHKVMEFKSLLLSLCLFHGNALERRKFGPLGFNIPYEFTDGDLRICISQLKMFLDEYDDIPYKVLKYTAGEINYGGRVTDDWDRRCIMNILEDFYNPDVLSPEHSYSASGIYHQIPPTYDLHGYLSYIKSLPLNDMPEIFGLHDNANITFAQNETFALLGTIIQLQPKSSSAGSQGREEIVEDVTQNILLKVPEPINLQWVMAKYPVLYEESMNTVLVQEVIRYNRLLQVITQTLQDLLKALKGLVVMSSQLELMAASLYNNTVPELWSAKAYPSLKPLSSWVMDLLQRLDFLQAWIQDGIPAVFWISGFFFPQAFLTGTLQNFARKFVISIDTISFDFKVMFEAPSELTQRPQVGCYIHGLFLEGARWDPEAFQLAESQPKELYTEMAVIWLLPTPNRKAQDQDFYLCPIYKTLTRAGTLSTTGHSTNYVIAVEIPTHQPQRHWIKRGVALICALDY

SEQ ID NO: 26039 - protein, 193 aa, Homo sapiens
  Payload ID: 5149
  Gene Symbol: DNAH1
  Gene Name: dynein, axonemal, heavy chain 1
  ENSP ID: ENSP00000418688
  MOD_RES (1)..(1): Any amino acid
XSGDVLVAAGFVAYLGPFTIAGLPNDTLSVENGVINQFSQRWTHFIDPQSQANKWIKNMEKDNGLDVFKLSDRDFLRSMENAIRFGKPCLLENVGEELDPALEPVLLKQTYKQQGNTVLKLGDTVIPYHEDFRMYITTKLPNPHYTPEISTKLTLINFTLSPSGLEDQLLGQVVAEERPDLEEAKNQLIISNA

SEQ ID NO: 26040 - protein, 928 aa, Homo sapiens
  Payload ID: 5149
  Gene Symbol: DNAH1
  Gene Name: dynein, axonemal, heavy chain 1
  ENSP ID: ENSP00000419071
KKEELELKCEQCEQRLGRAGKLINGLSDEKVRWQETVENLQYMLNNISGDVLVAAGFVAYLGPFTGQYRTVLYDSWVKQLRSHNVPHTSEPTLIGTLGNPVKIRSWQIAGLPNDTLSVENGVINQFSQRWTHFIDPQSQANKWIKNMEKDNGLDVFKLSDRDFLRSMENAIRFGKPCLLENVGEELDPALEPVLLKQTYKQQGNTVLKLGDTVIPYHEDFRMYITTKLPNPHYTPEISTKLTLINFTLSPSGLEDQLLGQVVAEERPDLEEAKNQLIISNAKMRQELKDIEDQILYRLSSSEGNPVDDMELIKVLEASKMKAAEIQAKVRIAEQTEKDIDLTRMEYIPVAIRTQILFFCVSDLANVDPMYQYSLEWFLNIFLSGIANSERADNLKKRISNINRYLTYSLYSNVCRSLFEKHKLMFAFLLCVRIMMNEGKINQSEWRYLLSGGSISIMTENPAPDWLSDRAWRDILALSNLPTFSSFSSDFVKHLSEFRVIFDSLEPHREPLPGIWDQYLDQFQKLLVLRCLRGDKVTNAMQDFVATNLEPRFIEPQTANLSVVFKDSNSTTPLIFVLSPGTDPAADLYKFAEEMKFSKKLSAISLGQGQGPRAEAMMRSSIERGKWVFFQNCHLAPSWMPALERLIEHINPDKVHRDFRLWLTSLPSNKFPVSILQNGSKMTIEPPRGVRANLLKSYSSLGEDFLNSCHKVMEFKSLLLSLCLFHGNALERRKFGPLGFNIPYEFTDGDLRICISQLKMFLDEYDDIPYKVLKYTAGEINYGGRVTDDWDRRCIMNILEDFYNPDVLSPEHSYSASGIYHQIPPTYDLHGYLSYIKSLPLNDMPEIFGLHDNANITFAQNETFALLGTIIQLQPKSSSAGSQGREEVQSAAAGDHTDTARPTQGTQGAGSDVLSAGADGCQPVQQYCA

SEQ ID NO: 26041 - protein, 4471 aa, Homo sapiens
  Payload ID: 5150
  Gene Symbol: DNAH10
  Gene Name: dynein, axonemal, heavy chain 10
  Uniprot ID: Q8IVF4
  ENSP ID: ENSP00000386770
MVPEEVEVEIDEIPVLSEEGEEEEETYSQKVESVDKVRAKRVSLRTESLGQPLNREDEEMDKEISEKLPSKRTAKHIMEKMHLHMLCTPLPEEFLDQNVVFFLRNTKEAISEATDMKEAMEIMPETLEYGIINANVLHFLKNIICQVFLPALSFNQHRTSTTVGVTSGEVSNSSEHESDLPPMPGEAVEYHSIQLIRDEFLMNVQKFASNIQRTMQQLEGEIKLEMPIISVEGEVSDLAADPETVDILEQCVINWLNQISTAVEAQLKKTPQGKGPLAEIEFWRERNATLSALHEQTKLPIVRKVLDVIKESDSMLVANLQPVFTELFKFHTEASDNVRFLSTVERYFKNITHGSGFHVVLDTIPAMMSALRMVWIISRHYNKDERMIPLMERIAWEIAERVCRVVNLRTLFKENRASAQSKTLEARNTLRLWKKAYFDTRAKIEASGREDRWEFDRKRLFERTDYMATICQDLSDVLQILEEFYNIFGPELKAVTGDPKRIDDVLCRVDGLVTPMENLTFDPFSIKSSQFWKYVMDEFKIEVLIDIINKIFVQNLENPPLYKNHPPVAGAIYWERSLFFRIKHTILRFQEVQEILDSDRGQEVKQKYLEVGRTMKEYEDRKYEQWMEVTEQVLPALMKKSLLTKSSIATEEPSTLERGAVFAINFSPALREIINETKYLEQLGFTVPELARNVALQEDKFLRYTAGIQRMLDHYHMLIGTLNDAESVLLKDHSQELLRVFRSGYKRLNWNSLGIGDYITGCKQAIGKFESLVHQIHKNADDISSRLTLIEAINLFKYPAAKSEEELPGVKEFFEHIERERASDVDHMVRWYLAIGPLLTKVEGLVVHTNTGKAPKLASYYKYWEKKIYEVLTKLILKNLQSFNSLILGNVPLFHTETILTAPEIILHPNTNEIDKMCFHCVRNCVEITKHFVRWMNGSCIECPPQKGEEEEVVIINFYNDISLNPQIIEQAVMIPQNVHRILINLMKYLQKWKRYRPLWKLDKAIVMEKFAAKKPPCVAYDEKLQFYSKIAYEVMRHPLIKDEHCIRLQLRHLANTVQENAKSWVISLGKLLNESAKEELYNLHEEMEHLAKNLRKIPNTLEDLKFVLATIAEIRSKSLVMELRYRDVQERYRTMAMYNLFPPDAEKELVDKIESIWSNLFNDSVNVEHALGDIKRTFTELTRGEIMNYRVQIEEFAKRFYSEGPGSVGDDLDKGVELLGVYERELARHEKSRQELANAEKLFDLPITMYPELLKVQKEMSGLRMIYELYEGLKVAKEEWSQTLWINLNVQILQEGIEGFLRALRKLPRPVRGLSVTYYLEAKMKAFKDSIPLLLDLKNEALRDRHWKELMEKTSVFFEMTETFTLENMFAMELHKHTDVLNEIVTAAIKEVAIEKAVKEILDTWENMKFTVVKYCKGTQERGYILGSVDEIIQSLDDNTFNLQSISGSRFVGPFLQTVHKWEKTLSLIGEVIEIWMLVQRKWMYLESIFIGGDIRSQLPEEAKKFDNIDKVFKRIMGETLKDPVIKRCCEAPNRLSDLQNVSEGLEKCQKSLNDYLDSKRNAFPRFFFISDDELLSILGSSDPLCVQEHMIKMYDNIASLRFNDGDSGEKLVSAMISAEGEVMEFRKILRAEGRVEDWMTAVLNEMRRTNRLITKEAIFRYCEDRSRVDWMLLYQGMVVLAASQVWWTWEVEDVFHKAQKGEKQAMKNYGRKMHRQIDELVTRITMPLSKNDRKKYNTVLIIDVHARDIVDSFIRGSILEAREFDWESQLRFYWDREPDELNIRQCTGTFGYGYEYMGLNGRLVITPLTDRIYLTLTQALSMYLGGAPAGPAGTGKTETTKDLAKALGLLCVVTNCGEGMDYRAVGKIFSGLAQCGAWGCFDEFNRIDASVLSVISSQIQTIRNALIHQLTTFQFEGQEISLDSRMGIFITMNPGYAGRTELPESVKALFRPVVVIVPDLQQICEIMLFSEGFLEAKTLAKKMTVLYKLAREQLSKQYHYDFGLRALKSVLVMAGELKRGSSDLREDVVLMRALRDMNLPKFVFEDVPLFLGLISDLFPGLDCPRVRYPDFNDAVEQVLEENGYAVLPIQVDKVVQMFETMLTRHTTMVVGPTRGGKSVVINTLCQAQTKLGLTTKLYILNPKAVSVIELYGILDPTTRDWTDGVLSNIFREINKPTDKKERKYILFDGDVDALWVENMNSVMDDNRLLTLANGERIRLQAHCALLFEVGDLQYASPATVSRCGMVYVDPKNLKYRPYWKKWVNQIPNKVEQYNLNSLFEKYVPYLMDVIVEGIVDGRQAEKLKTIVPQTDLNMVTQLAKMLDALLEGEIEDLDLLECYFLEALYCSLGASLLEDGRMKFDEYIKRLASLSTVDTEGVWANPGELPGQLPTLYDFHFDNKRNQWVPWSKLVPEYIHAPERKFINILVHTVDTTRTTWILEQMVKIKQPVIFVGESGTSKTATTQNFLKNLSEETNIVLMVNFSSRTTSMDIQRNLEANVEKRTKDTYGPPMGKRLLVFMDDMNMPRVDEYGTQQPIALLKLLLEKGYLYDRGKELNCKSIRDLGFIAAMGKAGGGRNEVDPRFISLFSVFNVPFPSEESLHLIYSSILKGHTSTFHESIVAVSGKLTFCTLALYKNIVQDLPPTPSKFHYIFNLRDLSRVFNGLVLTNPERFQTVAQMVRVWRNECLRVFHDRLISETDKQLVQQHIGSLVVEHFKDDVEVVMRDPILFGDFQMALHEGEPRIYEDIQDYEAAKALFQEILEEYNESNTKMNLVLFDDALEHLTRVHRIIRMDRGHALLVGVGGSGKQSLSRLAAFTASCEVFEILLSRGYSENSFREDLKSLYLKLGIENKAMIFLFTDAHVAEEGFLELINNMLTSGIVPALFSEEEKESILSQIGQEALKQGMGPAKESVWQYFVNKSANNLHIVLGMSPVGDTLRTWCRNFPGMVNNTGIDWFMPWPPQALHAVAKSFLGYNPMIPAENIENVVKHVVLVHQSVDHYSQQFLQKLRRSNYVTPKNYLDFINTYSKLLDEKTQCNIAQCKRLDGGLDKLKEATIQLDELNQKLAEQKIVLAEKSAACEALLEEIAVNTAVAEEKKKLAEEKAMEIEEQNKVIAMEKAEAETTLAEVMPILEAAKLELQKLDKSDVTEIRSFAKPPKQVQTVCECILIMKGYKELNWKTAKGVMSDPNFLRSLMEIDFDSITQSQVKNIKGLLKTLNTTTEEMEAVSKAGLGMLKFVEAVMGYCDVFREIKPKREKVARLERNFYLTKRELERIQNELAAIQKELETLGAKYEAAILEKQKLQEEAEIMERRLIAADKLISGLGSENIRWLNDLDELMHRRVKLLGDCLLCAAFLSYEGAFTWEFRDEMVNRIWQNDILEREIPLSQPFRLESLLTDDVEISRWGSQGLPPDELSVQNGILTTRASRFPLCIDPQQQALNWIKRKEEKNNLRVASFNDPDFLKQLEMSIKYGTPFLFRDVDEYIDPVIDNVLEKNIKVSQGRQFIILGDKEVDYDSNFRLYLNTKLANPRYSPSVFGKAMVINYTVTLKGLEDQLLSVLVAYERRELEEQREHLIQETSENKNLLKDLEDSLLRELATSTGNMLDNVDLVHTLEETKSKATEVSEKLKLAEKTALDIDRLRDGYRPAARRGAILFFVLSEMALVNSMYQYSLIAFLEVFRLSLKKSLPDSILMKRLRNIMDTLTFSIYNHGCTGLFERHKLLFSFNMTIKIEQAEGRVPQEELDFFLKGNISLEKSKRKKPCAWLSDQGWEDIILLSEMFSDNFGQLPDDVENNQTVWQEWYDLDSLEQFPVPLGYDNNITPFQKLLILRCFRVDRVYRAVTDYVTVTMGEKYVQPPMISFEAIFEQSTPHSPIVFILSPGSDPATDLMKLAERSGFGGNRLKFLAMGQGQEKVALQLLETAVARGQWLMLQNCHLLVKWLKDLEKSLERITKPHPDFRLWLTTDPTKGFPIGILQKSLKVVTEPPNGLKLNMRATYFKISHEMLDQCPHPAFKPLVYVLAFFHAVVQERRKFGKIGWNVYYDFNESDFQVCMEILNTYLTKAFQQRDPRIPWGSLKYLIGEVMYGGRAIDSFDRRILTIYMDEYLGDFIFDTFQPFHFFRNKEVDYKIPVGDEKEKFVEAIEALPLANTPEVFGLHPNAEIGYYTQAARDMWAHLLELQPQTGESSSGISRDDYIGQVAKEIENKMPKVFDLDQVRKRLGTGLSPTSVVLLQELERFNKLVVRMTKSLAELQRALAGEVGMSNELDDVARSLFIGHIPNIWRRLAPDTLKSLGNWMVYFLRRFSQYMLWVTESEPSVMWLSGLHIPESYLTALVQATCRKNGWPLDRSTLFTQVTKFQDADEVNERAGQGCFVSGLYLEGADWDIEKGCLIKSKPKVLVVDLPILKIIPIEAHRLKLQNTFRTPVYTTSMRRNAMGVGLVFEADLFTTRHISHWVLQGVCLTLNSD

SEQ ID NO: 26042 - protein, 648 aa, Homo sapiens
  Payload ID: 5150
  Gene Symbol: DNAH10
  Gene Name: dynein, axonemal, heavy chain 10
  ENSP ID: ENSP00000444761
LESIFIGGDIRSQLPEEAKKFDNIDKVFKRIMGETLKDPVIKRCCEAPNRLSDLQNVSEGLEKCQKSLNDYLDSKRNAFPRFFFISDDELLSILGSSDPLCVQEHMIKMYDNIASLRFNDGDSGEKLVSAMISAEGEVMEFRKILRAEGRVEDWMTAVLNEMRRTNRLITKEAIFRYCEDRSRVDWMLLYQGMVVLAASQVWWTWEVEDVFHKAQKGEKQAMKNYGRKMHRQIDELVTRITMPLSKNDRKKYNTVLIIDVHARDIVDSFIRGSILEAREFDWESQLRFYWDREPDELNIRQCTGTFGYGYEYMGLNGRLVITPLTDRIYLTLTQALSMYLGGAPAGPAGTGKTETTKDLAKALGLLCVVTNCGEGMDYRAVGKIFSGLAQCGAWGCFDEFNRIDASVLSVISSQIQTIRNALIHQLTTFQFEGQEISLDSRMGIFITMNPGYAGRTELPESVKALFRPVVVIVPDLQQICEIMLFSEGFLEAKTLAKKMTVLYKLAREQLSKQYHYDFGLRALKSVLVMAGELKRGSSDLREDVVLMRALRDMNLPKFVFEDVPLFLGLISDLFPGLDCPRVRYPDFNDAVEQVLEENGYAVLPIQVDKVVQMFETMLTRHTTMVVGPTRGGKSVVINTLCQAQTNLS

SEQ ID NO: 26043 - protein, 319 aa, Homo sapiens
  Payload ID: 5150
  Gene Symbol: DNAH10
  Gene Name: dynein, axonemal, heavy chain 10
  ENSP ID: ENSP00000445308
MPGPLPGRPHTASMPSGTSVSCSSLLLFLPLLLCLVCAVLFHFCLSMAWSGRLLWLSLTLPGSGMPRSFAKPPKQVQTVCECILIMKGYKELNWKTAKGVMSDPNFLRSLMEIDFDSITQSQVKNIKGLLKTLNTTTEEMEAVSKAGLGMLKFVEAVMGYCDVFREIKPKREKVARLERNFYLTKRELERIQNELAAIQKELETLGAKYEAAILEKQKLQEEAEIMERRLIAADKLISGLGSENIRWLNDLDELMHRRVKLLGDCLLCAAFLSYEGAFTWEFRDEMVNRIWQNDILEREIPLSQPFRLESLLTDDVEIS

SEQ ID NO: 26044 - protein, 970 aa, Homo sapiens
  Payload ID: 5150
  Gene Symbol: DNAH10
  Gene Name: dynein, axonemal, heavy chain 10
  ENSP ID: ENSP00000479072
MPGEAVEYHSIQLIRDEFLMNVQKFASNIQRTMQQLEGEIKLEMPIISVEGEVSDLAADPETVDILEQCVINWLNQISTAVEAQLKKTPQGKGPLAEIEFWRERNATLSALHEQTKLPIVRKVLDVIKESDSMLVANLQPVFTELFKFHTEASDNVRFLSTVERYFKNITHGSGFHVVLDTIPAMMSALRMVWIISRHYNKDERMIPLMERIAWEIAERVCRVVNLRTLFKENRASAQSKTLEARNTLRLWKKAYFDTRAKIEASGREDRWEFDRKRLFERTDYMATICQDLSDVLQILEEFYNIFGPELKAVTGDPKRIDDVLCRVDGLVTPMENLTFDPFSIKSSQFWKYVMDEFKIEVLVIEKEAKHFIDESFKTLRSAEAAFDMLLKFKHIRSREAVNRQMMMKFNDILAQYCKEIDIINKIFVQNLENPPLYKNHPPVAGAIYWERSLFFRIKHTILRFQEVQEILDSDRGQEVKQKYLEVGRTMKEYEDRKYEQWMEVTEQVLPALMKKSLLTKSSIATEEPSTLERGAVFAINFSPALREIINETKYLEQLGFTVPELARNVALQEDKFLRYTAGIQRMLDHYHMLIGTLNDAESVLLKDHSQELLRVFRSGYKRLNWNSLGIGDYITGCKQAIGKFESLVHQIHKNADDISSRLTLIEAINLFKYPAAKSEEELPGVKEFFEHIERERASDVDHMVRWYLAIGPLLTKVEGLVVHTNTGKAPKLASYYKYWEKKIYEVLTKLILKNLQSFNSLILGNVPLFHTETILTAPEIILHPNTNEIDKMCFHCVRNCVEITKHFVRWMNGSCIECPPQKGEEEEVVIINFYNDISLNPQIIEQAVMIPQNVHRILINLMKYLQKWKRYRPLWKLDKAIVMEKFAAKKPPCVAYDEKLQFYSKIAYEVMRHPLIKDEHCIRLQLRHLANTVQENAKSWVISLGKLLNESAKEELYNLHEEMEVLNRCV

SEQ ID NO: 26045 - protein, 81 aa, Homo sapiens
  Payload ID: 5150
  Gene Symbol: DNAH10
  Gene Name: dynein, axonemal, heavy chain 10
  ENSP ID: ENSP00000485079
ERFNKLVVRMTKSLAELQRALAGEVGMSNELDDVARSLFIGHIPNIWRRLAPDTLKSLGNWMVYFLRRFSQYMLWLLLDGS

SEQ ID NO: 26046 - protein, 319 aa, Homo sapiens; identical to SEQ ID NO: 26043
  Payload ID: 5150
  Gene Symbol: DNAH10
  Gene Name: dynein, axonemal, heavy chain 10
  ENSP ID: ENSP00000487927

SEQ ID NO: 26047 - protein, 84 aa, Homo sapiens
  Payload ID: 5150
  Gene Symbol: DNAH10
  Gene Name: dynein, axonemal, heavy chain 10
  ENSP ID: ENSP00000487958
ERFNKLVVRMTKSLAELQRALAGEVGMSNELDDVARSLFIGHIPNIWRRLAPDTLKSLGNWMVYFLRRFSQYMLWLLLDGSWKG

SEQ ID NO: 26048 - protein, 3196 aa, Homo sapiens
  Payload ID: 5150
  Gene Symbol: DNAH10
  Gene Name: dynein, axonemal, heavy chain 10
  ENSP ID: ENSP00000488646
VAKEEWSQTLWINLNVQILQEGIEGFLRALRKLPRPVRGLSVTYYLEAKMKAFKDSIPLLLDLKNEALRDRHWKELMEKTSVFFEMTETFTLENMFAMELHKHTDVLNEIVTAAIKEVAIEKAVKEILDTWENMKFTVVKYCKGTQERGYILGSVDEIIQSLDDNTFNLQSISGSRFVGPFLQTVHKWEKTLSLIGEVIEIWMLVQRKWMYLESIFIGGDIRSQLPEEAKKFDNIDKVFKRIMGETLKDPVIKRCCEAPNRLSDLQNVSEGLEKCQKSLNDYLDSKRNAFPRFFFISDDELLSILGSSDPLCVQEHMIKMYDNIASLRFNDGDSGEKLVSAMISAEGEVMEFRKILRAEGRVEDWMTAVLNEMRRTNRLITKEAIFRYCEDRSRVDWMLLYQGMVVLAASQVWWTWEVEDVFHKAQKGEKQAMKNYGRKMHRQIDELVTRITMPLSKNDRKKYNTVLIIDVHARDIVDSFIRGSILEAREFDWESQLRFYWDREPDELNIRQCTGTFGYGYEYMGLNGRLVITPLTDRIYLTLTQALSMYLGGAPAGPAGTGKTETTKDLAKALGLLCVVTNCGEGMDYRAVGKIFSGLAQCGAWGCFDEFNRIDASVLSVISSQIQTIRNALIHQLTTFQFEGQEISLDSRMGIFITMNPGYAGRTELPESVKALFRPVVVIVPDLQQICEIMLFSEGFLEAKTLAKKMTVLYKLAREQLSKQYHYDFGLRALKSVLVMAGELKRGSSDLREDVVLMRALRDMNLPKFVFEDVPLFLGLISDLFPGLDCPRVRYPDFNDAVEQVLEENGYAVLPIQVDKVVQMFETMLTRHTTMVVGPTRGGKSVVINTLCQAQTKLGLTTKLYILNPKAVSVIELYGILDPTTRDWTDGVLSNIFREINKPTDKKERKYILFDGDVDALWVENMNSVMDDNRLLTLANGERIRLQAHCALLFEVGDLQYASPATVSRCGMVYVDPKNLKYRPYWKKWVNQIPNKVEQYNLNSLFEKYVPYLMDVIVEGIVDGRQAEKLKTIVPQTDLNMVTQLAKMLDALLEGEIEDLDLLECYFLEALYCSLGASLLEDGRMKFDEYIKRLASLSTVDTEGVWANPGELPGQLPTLYDFHFDNKRNQWVPWSKLVPEYIHAPERKFINILVHTVDTTRTTWILEQMVKIKQPVIFVGESGTSKTATTQNFLKNLSEETNIVLMVNFSSRTTSMDIQRNLEANVEKRTKDTYGPPMGKRLLVFMDDMNMPRVDEYGTQQPIALLKLLLEKGYLYDRGKELNCKSIRDLGFIAAMGKAGGGRNEVDPRFISLFSVFNVPFPSEESLHLIYSSILKGHTSTFHESIVAVSGKLTFCTLALYKNIVQDLPPTPSKFHYIFNLRDLSRVFNGLVLTNPERFQTVAQMVRVWRNECLRVFHDRLISETDKQLVQQHIGSLVVEHFKDDVEVVMRDPILFGDFQMALHEGEPRIYEDIQDYEAAKALFQEILEEYNESNTKMNLVLFDDALEHLTRVHRIIRMDRGHALLVGVGGSGKQSLSRLAAFTASCEVFEILLSRGYSENSFREDLKSLYLKLGIENKAMIFLFTDAHVAEEGFLELINNMLTSGIVPALFSEEEKESILSQIGQEALKQGMGPAKESVWQYFVNKSANNLHIVLGMSPVGDTLRTWCRNFPGMVNNTGIDWFMPWPPQALHAVAKSFLGYNPMIPAENIENVVKHVVLVHQSVDHYSQQFLQKLRRSNYVTPKNYLDFINTYSKLLDEKTQCNIAQCKRLDGGLDKLKEATIQLDELNQKLAEQKIVLAEKSAACEALLEEIAVNTAVAEEKKKLAEEKAMEIEEQNKVIAMEKAEAETTLAEVMPILEAAKLELQKLDKSDVTEIRSFAKPPKQVQTVCECILIMKGYKELNWKTAKGVMSDPNFLRSLMEIDFDSITQSQVKNIKGLLKTLNTTTEEMEAVSKAGLGMLKFVEAVMGYCDVFREIKPKREKVARLERNFYLTKRELERIQNELAAIQKELETLGAKYEAAILEKQKLQEEAEIMERRLIAADKLISGLGSENIRWLNDLDELMHRRVKLLGDCLLCAAFLSYEGAFTWEFRDEMVNRIWQNDILEREIPLSQPFRLESLLTDDVEISRWGSQGLPPDELSVQNGILTTRASRFPLCIDPQQQALNWIKRKEEKNNLRVASFNDPDFLKQLEMSIKYGTPFLFRDVDEYIDPVIDNVLEKNIKVSQGRQFIILGDKEVDYDSNFRLYLNTKLANPRYSPSVFGKAMVINYTVTLKGLEDQLLSVLVAYERRELEEQREHLIQETSENKNLLKDLEDSLLRELATSTGNMLDNVDLVHTLEETKSKATEVSEKLKLAEKTALDIDRLRDGYRPAARRGAILFFVLSEMALVNSMYQYSLIAFLEVFRLSLKKSLPDSILMKRLRNIMDTLTFSIYNHGCTGLFERHKLLFSFNMTIKIEQAEGRVPQEELDFFLKGNISLEKSKRKKPCAWLSDQGWEDIILLSEMFSDNFGQLPDDVENNQTVWQEWYDLDSLEQFPVPLGYDNNITPFQKLLILRCFRVDRVYRAVTDYVTVTMGEKYVQPPMISFEAIFEQSTPHSPIVFILSPGSDPATDLMKLAERSGFGGNRLKFLAMGQGQEKVALQLLETAVARGQWLMLQNCHLLVKWLKDLEKSLERITKPHPDFRLWLTTDPTKGFPIGILQKSLKVVTEPPNGLKLNMRATYFKISHEMLDQCPHPAFKPLVYVLAFFHAVVQERRKFGKIGWNVYYDFNESDFQVCMEILNTYLTKAFQQRDPRIPWGSLKYLIGEVMYGGRAIDSFDRRILTIYMDEYLGDFIFDTFQPFHFFRNKEVDYKIPVGDEKEKFVEAIEALPLANTPEVFGLHPNAEIGYYTQAARDMWAHLLELQPQTGESSSGISRDDYIGQVAKEIENKMPKVFDLDQVRKRLGTGLSPTSVVLLQELERFNKLVVRMTKSLAELQRALAGEVGMSNELDDVARSLFIGHIPNIWRRLAPDTLKSLGNWMVYFLRRFSQYMLWVTESEPSVMWLSGLHIPESYLTALVQATCRKNGWPLDRSTLFTQVTKFQDADEVNERAGQGCFVSGLYLEGADWDIEKGCLIKSKPKVLVVDLPILKIIPIEAHRLKLQNTFRTPVYTTSMRRNAMGVGLVFEADLFTTRHISHWVLQGVCLTLNSD

SEQ ID NO: 26049 - protein, 648 aa, Homo sapiens; identical to SEQ ID NO: 26042
  Payload ID: 5150
  Gene Symbol: DNAH10
  Gene Name: dynein, axonemal, heavy chain 10
  ENSP ID: ENSP00000488833

SEQ ID NO: 26050 - protein, 163 aa, Homo sapiens
  Payload ID: 5151
  Gene Symbol: DNAH10OS
  Gene Name: dynein, axonemal, heavy chain 10 opposite strand
  Uniprot ID: P0CZ25
  ENSP ID: ENSP00000422769
MHSLPRSGSIRRTHSDTQATGWPPPQRIGDSPGPSPAFLSCPPSLCGGAAQTGDPVALPHGPEKWVWGGGLSPRNPHSWGIKAHGLRPPWAPRLERCMVPESEWAPWQPQLPCEPKWLGSRKSKPHRESGLRGGGPSRCAKRGTHSCGPRESGGPDTCHLPCH

SEQ ID NO: 26051 - protein, 4523 aa, Homo sapiens
  Payload ID: 5152
  Gene Symbol: DNAH11
  Gene Name: dynein, axonemal, heavy chain 11
  ENSP ID: ENSP00000330671
MAAQVAAREARDFREAPTLRLTSGAGLEAVGAVELEEEEENEEEAAARRARSFAQDARVRFLGGRLAMMLGFTEEKWSQYLESEDNRQVLGEFLESTSPACLVFSFAASGRLAASQEIPRDANHKLVFISKKITESIGVNDFSQVVLFGELPALSLGHVSAFLDEILVPVLSNKNNHKSWSCFTSQDMEYHIEVMKKKMYIFRGKMSRRTLLPIPTVAGKMDLDQNCSENKPPSNERIILHAIESVVIEWSHQIQEIIERDSVQRLLNGLHLSPQAELDFWMMRRENLSCIYDQLQAPVVLKMVKILTTKQSSYFPTLKDIFLAVENALLEAQDVELYLRPLRRHIQCLQETEFPQTRILIAPLFHTICLIWSHSKFYNTPARVIVLLQEFCNLFINQATAYLSPEDLLRGEIEESLEKVQVAVNILKTFKNSFFNYRKKLASYFMGRKLRPWDFQSHLVFCRFDKFLDRLIKIEDIFATTLEFEKLERLEFGGTKGAILNGQVHEMSEELMELCKLFKQSTYDPSDCTNMEFESDYVAFKSKTLEFDRRLGTIICEAFFNCNGLEAAFKLLTIFGNFLEKPVVMEIFSLHYSTLVHMFNTELDVCKQLYNEHMKQIECGHVVLNKNMPFTSGNMKWAQQVLQRLQMFWSNFASLRYLFLGNPDHALVYQKYVEMTTLLDQFESRIYNEWKSNVDEICEFNLNQPLVKFSAINGLLCVNFDPKLVAVLREVKYLLMLKKQDIPDSALAIFKKRNTILKYIGNLDLLVQGYNKLKQTLLEVEYPLIEDELRAIDEQLTAATTWLTWQDDCWGYIERVRAATSELEHRVERTQKNVKVIQQTMRGWARCVLPPRREHRREAAFTLEDKGDLFTKKYKLIQGDGCKIHNLVEENRKLFKANPSLDTWKIYVEFIDDIVVEGFFQAIMHDLDFFLKNTEKQLKPAPFFQAQMILLPPEIVFKPSLDREAGDGFYDLVEEMLCNSFRMSAQMNRIATHLEIKNYQNDMDNMLGLAEVRQEIMNRVVNVINKVLDFRNTLETHTYLWVDDRAEFMKHFLLYGHAVSSDEMDAHANEEIPEQPPTLEQFKEQIDIYEALYVQMSKFEDFRVFDSWFKVDMKPFKVSLLTIIKKWSWMFQEHLLRFVIDSLNELQEFIKETDSGLQRELNEGDHDGLVDIMVHLLAVRSRQRATDELFEPLKETITLLESYGQKMPEQVYIQLEELPERWETTKKIAATVRHEVSPLHNAEVTLIRKKCILFDAKQAEFRERFRHYAPLGFNAENPYTALDKANEELEALEEEMLQMQESTRLFEVALPEYKQMKQCRKEIKLLKGLWDVIIYVRRSIDNWTKTQWRQIHVEQMDVELRRFAKASSITEIWSLNKEVRVWDAYTGLEGTVKDMTASLRAITELQSPALRDRHWHQLMKAIGVKFLINEATTLADLLALRLHRVEDDVRRIVDKAVKELGTEKVITEISQTWATMKFSYEVHYRTGIPLLKSDEQLFETLEHNQVQLQTLLQSKYVEYFIEQVLSWQNKLNIADLVIFTWMEVQRTWSHLESIFVCSEDIRIQLVKDARRFDGVDAEFKELMFKTAKVENVLEATCRPNLYEKLKDLQSRLSLCEKALAEYLETKRIAFPRFYFVSSADLLDILSKGAQPKQVTCHLAKLFDSIADLQFEDNQDVSAHRAVGMYSKEKEYVPFQAECECVGHVETWLLQLEQTMQETVRHSITEAIVAYEEKPRELWIFDFPAQVALTSSQIWWTTDVGIAFSRLEEGYETALKDFHKKQISQLNTLITLLLGELPPGDRQKIMTICTIDVHARDVVAKLISQKKVVVSPQAFTWLSQLRHRWEDTQKHCFVNICDAQFQYFYEYLGNSPRLVITPLTDRCYITLTQSLHLTMSGAPAGPAGTGKTETTKDLGRALGMMVYVFNCSEQMDYKSIGNIYKGLVQTGAWGCFDEFNRISVEVLSVVAVQVKMIHDAIRNRKKRFVFLGEAITLKPSVGIFITMNPGYAGRTELPENLKALFRPCAMVAPDIELICEILLVAEGFVDARALARKFITLYTLCKELLSKQDHYDWGLRAIKSVLVVAGSLKRGDKNRPEDQVLMRALRDFNMPKIVTDDIPVFLGLVGDLFPALDVPRRRKLHFEQMVRQSTLELRLQPEESFILKVVQLEELLAVRHSVFVVGNAGTGKSKILRTLNRTYVNMKQKPVWNDLNPKAVTTDELFGFIHHATREWKDGKIVYSYFIGLFSSILREQANLKHDGPKWIVLDGDIDPMWIESLNTVMDDNKVLTLASNERIALTPFMRLLFEIHHLRSATPATVSRAGILYVNPQDLGWNPYVASWIDRRRHQSEKANLTILFDKYVPACLDKLRTSFKTITSIPESSLVQTLCVLLECLLTPENVPSDSPKEVYEVYFVFACIWAFGGTLLQDQISDYQADFSRWWQKEMKAVKFPSQGTIFDYYVDHKTKKLLPWADKIAQFTMDPDVPLQTVLVHTTETARLRYFMELLLEKGKPLMLVGNAGVGKTVFVGDTLASLSEDYIVSRVPFNYYTTSTALQKILEKPLEKKAGHNYGPGGNKKLIYFIDDMNMPEVDLYGTVQPHTLIRQHIDYGHWYDRQKVMLKEIHNCQYVACMNPMVGSFTINPRLQRHFTVFAFNFPSLDALNTIYGQIFSFHFQQQAFAPSILRSGPTLIQATIAFHQTMMCNFLPTAIKFHYIFNLRDLSNVFQGILFASPECLKGPLDLIHLWLHESARVYGDKLIDKKDCDLFQRRMLETAYKYFEGIDSHMLLQQPLIYCHFADRGKDPHYMPVKDWEVLKTILTETLDNYNELNAAMHLVLFEDAMQHVCRISRILRTPQGCALLVGVGGSGKQSLSRLAAYLRGLEVFQITLTEGYGIQELRVDLANLYIRTGAKNMPTVFLLTDAQVLDESFLVLINDLLASGEIPDLFSDEDVDKIISGIHNEVHALGMVDSRENCWKFFMARVRLQLKIILCFSPVGRTLRVRARKFPAIVNCTAIDWFHAWPQEALVSVSRRFIEETKGIEPVHKDSISLFMAHVHTTVNEMSTRYYQNERRHNYTTPKSFLEQISLFKNLLKKKQNEVSEKKERLVNGIQKLKTTASQVGDLKARLASQEAELQLRNHDAEALITKIGLQTEKVSREKTIADAEERKVTAIQTEVFQKQRECEADLLKAEPALVAATAALNTLNRVNLSELKAFPNPPIAVTNVTAAVMVLLAPRGRVPKDRSWKAAKVFMGKVDDFLQALINYDKEHIPENCLKVVNEHYLKDPEFNPNLIRTKSFAAAGLCAWVINIIKFYEVYCDVEPKRQALAQANLELAAATEKLEAIRKKLVDLDRNLSRLTASFEKATAEKVRCQEEVNQTNKTIKLANRLVKELEAKKIRWGQSIKSFEAQEKTLCGDVLLTAAFVSYVGPFTRQYRQELVHCKWVPFLQQKVSIPLTEGLDLISMLTDDATIAAWNNEGLPSDRMSTENAAILTHCERWPLVIDPQQQGIKWIKNKYGMDLKVTHLGQKGFLNAIETALAFGDVILIENLEETIDPVLDPLLGRNTIKKGKYIRIGDKECEFNKNFRLILHTKLANPHYKPELQAQTTLLNFTVTEDGLEAQLLAEVVSIERPDLEKLKLVLTKHQNDFKIELKYLEDDLLLRLSAAEGSFLDDTKLVERLEATKTTVAEIEHKVIEAKENERKINEARECYRPVAARASLLYFVINDLQKINPLYQFSLKAFNVLFHRAIEQADKVEDMQGRISILMESITHAVFLYTSQALFEKDKLTFLSQMAFQILLRKKEIDPLELDFLLRFTVEHTHLSPVDFLTSQSWSAIKAIAVMEEFRGIDRDVEGSAKQWRKWVESECPEKEKLPQEWKKKSLIQKLILLRAMRPDRMTYALRNFVEEKLGAKYVERTRLDLVKAFEESSPATPIFFILSPGVDALKDLEILGKRLGFTIDSGKFHNVSLGQGQETVAEVALEKASKGGHWVILQNVHLVAKWLGTLEKLLERFSQGSHRDYRVFMSAESAPTPDEHIIPQGLLENSIKITNEPPTGMLANLHAALYNFDQDTLEICSKEQEFKSILFSLCYFHACVAGRLRFGPQGWSRSYPFNPGDLTICASVLYNYLEANSKVPWEDLRYLFGEIMYGGHITDDWDRKLCRVYLEEFMNPSLTEDELMLAPGFAAPPYLDYAGYHQYIEEMLPPESPALYGLHPNAEIEFLTVTSNTLFRTLLEMQPRNALSGDELGQSTEEKVKNVLDDILEKLPEEFNMAEIMQKNSNRSPYVLVCFQECERMNILIREIRISLEQLDLSLKGELALSPAVEAQQFALSYDTVPDTWSKLAYPSTYGLAQWFNDLLLRCRELDTWTQDLTLPAVVWLSGFFNPQSFLTAIMQTMARKNEWPLDKTRLTADVTKKTKEDYGHPPREGAYLHGLFMEGARWDTQAGTIVEARLKELACPMPVIFAKATPVDRQETKQTYECPVYRTKLRGPSYIWTFRLKSEEKTAKWVLAGVALLLEA

SEQ ID NO: 26052 - protein, 4516 aa, Homo sapiens
  Payload ID: 5152
  Gene Symbol: DNAH11
  Gene Name: dynein, axonemal, heavy chain 11
  Uniprot ID: Q96DT5
  ENSP ID: ENSP00000475939
MAAQVAAREARDFREAPTLRLTSGAGLEAVGAVELEEEEENEEEAAARRARSFAQDARVRFLGGRLAMMLGFTEEKWSQYLESEDNRQVLGEFLESTSPACLVFSFAASGRLAASQEIPRDANHKLVFISKKITESIGVNDFSQVVLFGELPALSLGHVSAFLDEILVPVLSNKNNHKSWSCFTSQDMEYHIEVMKKKMYIFRGKMSRRTLLPIPTVAGKMDLDQNCSENKPPSNERIILHAIESVVIEWSHQIQEIIERDSVQRLLNGLHLSPQAELDFWMMRRENLSCIYDQLQAPVVLKMVKILTTKQSSYFPTLKDIFLAVENALLEAQDVELYLRPLRRHIQCLQETEFPQTRILIAPLFHTICLIWSHSKFYNTPARVIVLLQEFCNLFINQATAYLSPEDLLRGEIEESLEKVQVAVNILKTFKNSFFNYRKKLASYFMGRKLRPWDFQSHLVFCRFDKFLDRLIKIEDIFATTLEFEKLERLEFGGTKGAILNGQVHEMSEELMELCKLFKQSTYDPSDCTNMEFESDYVAFKSKTLEFDRRLGTIICEAFFNCNGLEAAFKLLTIFGNFLEKPVVMEIFSLHYSTLVHMFNTELDVCKQLYNEHMKQIECGHVVLNKNMPFTSGNMKWAQQVLQRLQMFWSNFASLRYLFLGNPDHALVYQKYVEMTTLLDQFESRIYNEWKSNVDEICEFNLNQPLVKFSAINGLLCVNFDPKLVAVLREVKYLLMLKKQDIPDSALAIFKKRNTILKYIGNLDLLVQGYNKLKQTLLEVEYPLIEDELRAIDEQLTAATTWLTWQDDCWGYIERVRAATSELEHRVERTQKNVKVIQQTMRGWARCVLPPRREHRREAAFTLEDKGDLFTKKYKLIQGDGCKIHNLVEENRKLFKANPSLDTWKIYVEFIDDIVVEGFFQAIMHDLDFFLKNTEKQLKPAPFFQAQMILLPPEIVFKPSLDREAGDGFYDLVEEMLCNSFRMSAQMNRIATHLEIKNYQNDMDNMLGLAEVRQEIMNRVVNVINKVLDFRNTLETHTYLWVDDRAEFMKHFLLYGHAVSSDEMDAHANEEIPEQPPTLEQFKEQIDIYEALYVQMSKFEDFRVFDSWFKVDMKPFKVSLLTIIKKWSWMFQEHLLRFVIDSLNELQEFIKETDSGLQRELNEGDHDGLVDIMVHLLAVRSRQRATDELFEPLKETITLLESYGQKMPEQVYIQLEELPERWETTKKIAATVRHEVSPLHNAEVTLIRKKCILFDAKQAEFRERFRHYAPLGFNAENPYTALDKANEELEALEEEMLQMQESTRLFEVALPEYKQMKQCRKEIKLLKGLWDVIIYVRRSIDNWTKTQWRQIHVEQMDVELRRFAKEIWSLNKEVRVWDAYTGLEGTVKDMTASLRAITELQSPALRDRHWHQLMKAIGVKFLINEATTLADLLALRLHRVEDDVRRIVDKAVKELGTEKVITEISQTWATMKFSYEVHYRTGIPLLKSDEQLFETLEHNQVQLQTLLQSKYVEYFIEQVLSWQNKLNIADLVIFTWMEVQRTWSHLESIFVCSEDIRIQLVKDARRFDGVDAEFKELMFKTAKVENVLEATCRPNLYEKLKDLQSRLSLCEKALAEYLETKRIAFPRFYFVSSADLLDILSKGAQPKQVTCHLAKLFDSIADLQFEDNQDVSAHRAVGMYSKEKEYVPFQAECECVGHVETWLLQLEQTMQETVRHSITEAIVAYEEKPRELWIFDFPAQVALTSSQIWWTTDVGIAFSRLEEGYETALKDFHKKQISQLNTLITLLLGELPPGDRQKIMTICTIDVHARDVVAKLISQKVVSPQAFTWLSQLRHRWEDTQKHCFVNICDAQFQYFYEYLGNSPRLVITPLTDRCYITLTQSLHLTMSGAPAGPAGTGKTETTKDLGRALGMMVYVFNCSEQMDYKSIGNIYKGLVQTGAWGCFDEFNRISVEVLSVVAVQVKMIHDAIRNRKKRFVFLGEAITLKPSVGIFITMNPGYAGRTELPENLKALFRPCAMVAPDIELICEILLVAEGFVDARALARKFITLYTLCKELLSKQDHYDWGLRAIKSVLVVAGSLKRGDKNRPEDQVLMRALRDFNMPKIVTDDIPVFLGLVGDLFPALDVPRRRKLHFEQMVRQSTLELRLQPEESFILKVVQLEELLAVRHSVFVVGNAGTGKSKILRTLNRTYVNMKQKPVWNDLNPKAVTTDELFGFIHHATREWKDGKIVYSYFIGLFSSILREQANLKHDGPKWIVLDGDIDPMWIESLNTVMDDNKVLTLASNERIALTPFMRLLFEIHHLRSATPATVSRAGILYVNPQDLGWNPYVASWIDRRRHQSEKANLTILFDKYVPACLDKLRTSFKTITSIPESSLVQTLCVLLECLLTPENVPSDSPKEVYEVYFVFACIWAFGGTLLQDQISDYQADFSRWWQKEMKAVKFPSQGTIFDYYVDHKTKKLLPWADKIAQFTMDPDVPLQTVLVHTTETARLRYFMELLLEKGKPLMLVGNAGVGKTVFVGDTLASLSEDYIVSRVPFNYYTTSTALQKILEKPLEKKAGHNYGPGGNKKLIYFIDDMNMPEVDLYGTVQPHTLIRQHIDYGHWYDRQKVMLKEIHNCQYVACMNPMVGSFTINPRLQRHFTVFAFNFPSLDALNTIYGQIFSFHFQQQAFAPSILRSGPTLIQATIAFHQTMMCNFLPTAIKFHYIFNLRDLSNVFQGILFASPECLKGPLDLIHLWLHESARVYGDKLIDKKDCDLFQRRMLETAYKYFEGIDSHMLLQQPLIYCHFADRGKDPHYMPVKDWEVLKTILTETLDNYNELNAAMHLVLFEDAMQHVCRISRILRTPQGCALLVGVGGSGKQSLSRLAAYLRGLEVFQITLTEGYGIQELRVDLANLYIRTGAKNMPTVFLLTDAQVLDESFLVLINDLLASGEIPDLFSDEDVDKIISGIHNEVHALGMVDSRENCWKFFMARVRLQLKIILCFSPVGRTLRVRARKFPAIVNCTAIDWFHAWPQEALVSVSRRFIEETKGIEPVHKDSISLFMAHVHTTVNEMSTRYYQNERRHNYTTPKSFLEQISLFKNLLKKKQNEVSEKKERLVNGIQKLKTTASQVGDLKARLASQEAELQLRNHDAEALITKIGLQTEKVSREKTIADAEERKVTAIQTEVFQKQRECEADLLKAEPALVAATAALNTLNRVNLSELKAFPNPPIAVTNVTAAVMVLLAPRGRVPKDRSWKAAKVFMGKVDDFLQALINYDKEHIPENCLKVVNEHYLKDPEFNPNLIRTKSFAAAGLCAWVINIIKFYEVYCDVEPKRQALAQANLELAAATEKLEAIRKKLVDLDRNLSRLTASFEKATAEKVRCQEEVNQTNKTIKLANRLVKELEAKKIRWGQSIKSFEAQEKTLCGDVLLTAAFVSYVGPFTRQYRQELVHCKWVPFLQQKVSIPLTEGLDLISMLTDDATIAAWNNEGLPSDRMSTENAAILTHCERWPLVIDPQQQGIKWIKNKYGMDLKVTHLGQKGFLNAIETALAFGDVILIENLEETIDPVLDPLLGRNTIKKGKYIRIGDKECEFNKNFRLILHTKLANPHYKPELQAQTTLLNFTVTEDGLEAQLLAEVVSIERPDLEKLKLVLTKHQNDFKIELKYLEDDLLLRLSAAEGSFLDDTKLVERLEATKTTVAEIEHKVIEAKENERKINEARECYRPVAARASLLYFVINDLQKINPLYQFSLKAFNVLFHRAIEQADKVEDMQGRISILMESITHAVFLYTSQALFEKDKLTFLSQMAFQILLRKKEIDPLELDFLLRFTVEHTHLSPVDFLTSQSWSAIKAIAVMEEFRGIDRDVEGSAKQWRKWVESECPEKEKLPQEWKKKSLIQKLILLRAMRPDRMTYALRNFVEEKLGAKYVERTRLDLVKAFEESSPATPIFFILSPGVDALKDLEILGKRLGFTIDSGKFHNVSLGQGQETVAEVALEKASKGGHWVILQNVHLVAKWLGTLEKLLERFSQGSHRDYRVFMSAESAPTPDEHIIPQGLLENSIKITNEPPTGMLANLHAALYNFDQDTLEICSKEQEFKSILFSLCYFHACVAGRLRFGPQGWSRSYPFNPGDLTICASVLYNYLEANSKVPWEDLRYLFGEIMYGGHITDDWDRKLCRVYLEEFMNPSLTEDELMLAPGFAAPPYLDYAGYHQYIEEMLPPESPALYGLHPNAEIEFLTVTSNTLFRTLLEMQPRNALSGDELGQSTEEKVKNVLDDILEKLPEEFNMAEIMQKNSNRSPYVLVCFQECERMNILIREIRISLEQLDLSLKGELALSPAVEAQQFALSYDTVPDTWSKLAYPSTYGLAQWFNDLLLRCRELDTWTQDLTLPAVVWLSGFFNPQSFLTAIMQTMARKNEWPLDKTRLTADVTKKTKEDYGHPPREGAYLHGLFMEGARWDTQAGTIVEARLKELACPMPVIFAKATPVDRQETKQTYECPVYRTKLRGPSYIWTFRLKSEEKTAKWVLAGVALLLEA

SEQ ID NO: 26053 - protein, 174 aa, Homo sapiens
  Payload ID: 5152
  Gene Symbol: DNAH11
  Gene Name: dynein, axonemal, heavy chain 11
  ENSP ID: ENSP00000476068
TVLVHTTETARLRYFMELLLEKGKPLMLVGNAGVGKTVFVGDTLASLSEDYIVSRVPFNYYTTSTALQKILEKPLEKKAGHNYGPGGNKKLIYFIDDMNMPEVDLYGTVQPHTLIRQHIDYGHWYDRQKVMLKEIHNCQYVACMNPMVGSFTINPRLQGIDSHMLLQQPLIYCH

SEQ ID NO: 26054 - protein, 4523 aa, Homo sapiens
  Payload ID: 5152
  Gene Symbol: DNAH11
  Gene Name: dynein, axonemal, heavy chain 11
  ENSP ID: ENSP00000481693
MAAQVAAREARDFREAPTLRLTSGAGLEAVGAVELEEEEENEEEAAARRARSFAQDARVRFLGGRLAMMLGFTEEKWSQYLESEDNRQVLGEFLESTSPACLVFSFAASGRLAASQEIPRDANHKLVFISKKITESIGVNDFSQVVLFGELPALSLGHVSAFLDEILVPVLSNKNNHKSWSCFTSQDMEYHIEVMKKKMYIFRGKMSRRTLLPIPTVAGKMDLDQNCSENKPPSNERIILHAIESVVIEWSHQIQEIIERDSVQRLLNGLHLSPQAELDFWMMRRENLSCIYDQLQAPVVLKMVKILTTKQSSYFPTLKDIFLAVENALLEAQDVELYLRPLRRHIQCLQETEFPQTRILIAPLFHTICLIWSHSKFYNTPARVIVLLQEFCNLFINQATAYLSPEDLLRGEIEESLEKVQVAVNILKTFKNSFFNYRKKLASYFMGRKLRPWDFQSHLVFCRFDKFLDRLIKIEDIFATTLEFEKLERLEFGGTKGAILNGQVHEMSEELMELCKLFKQSTYDPSDCTNMEFESDYVAFKSKTLEFDRRLGTIICEAFFNCNGLEAAFKLLTIFGNFLEKPVVMEIFSLHYSTLVHMFNTELDVCKQLYNEHMKQIECGHVVLNKNMPFTSGNMKWAQQVLQRLQMFWSNFASLRYLFLGNPDHALVYQKYVEMTTLLDQFESRIYNEWKSNVDEICEFNLNQPLVKFSAINGLLCVNFDPKLVAVLREVKYLLMLKKQDIPDSALAIFKKRNTILKYIGNLDLLVQGYNKLKQTLLEVEYPLIEDELRAIDEQLTAATTWLTWQDDCWGYIERVRAATSELEHRVERTQKNVKVIQQTMRGWARCVLPPRREHRREAAFTLEDKGDLFTKKYKLIQGDGCKIHNLVEENRKLFKANPSLDTWKIYVEFIDDIVVEGFFQAIMHDLDFFLKNTEKQLKPAPFFQAQMILLPPEIVFKPSLDREAGDGFYDLVEEMLCNSFRMSAQMNRIATHLEIKNYQNDMDNMLGLAEVRQEIMNRVVNVINKVLDFRNTLETHTYLWVDDRAEFMKHFLLYGHAVSSDEMDAHANEEIPEQPPTLEQFKEQIDIYEALYVQMSKFEDFRVFDSWFKVDMKPFKVSLLTIIKKWSWMFQEHLLRFVIDSLNELQEFIKETDSGLQRELNEGDHDGLVDIMVHLLAVRSRQRATDELFEPLKETITLLESYGQKMPEQVYIQLEELPERWETTKKIAATVRHEVSPLHNAEVTLIRKKCILFDAKQAEFRERFRHYAPLGFNAENPYTALDKANEELEALEEEMLQMQESTRLFEVALPEYKQMKQCRKEIKLLKGLWDVIIYVRRSIDNWTKTQWRQIHVEQMDVELRRFAKASSITEIWSLNKEVRVWDAYTGLEGTVKDMTASLRAITELQSPALRDRHWHQLMKAIGVKFLINEATTLADLLALRLHRVEDDVRRIVDKAVKELGTEKVITEISQTWATMKFSYEVHYRTGIPLLKSDEQLFETLEHNQVQLQTLLQSKYVEYFIEQVLSWQNKLNIADLVIFTWMEVQRTWSHLESIFVCSEDIRIQLVKDARRFDGVDAEFKELMFKTAKVENVLEATCRPNLYEKLKDLQSRLSLCEKALAEYLETKRIAFPRFYFVSSADLLDILSKGAQPKQVTCHLAKLFDSIADLQFEDNQDVSAHRAVGMYSKEKEYVPFQAECECVGHVETWLLQLEQTMQETVRHSITEAIVAYEEKPRELWIFDFPAQVALTSSQIWWTTDVGIAFSRLEEGYETALKDFHKKQISQLNTLITLLLGELPPGDRQKIMTICTIDVHARDVVAKLISQKQVVVSPQAFTWLSQLRHRWEDTQKHCFVNICDAQFQYFYEYLGNSPRLVITPLTDRCYITLTQSLHLTMSGAPAGPAGTGKTETTKDLGRALGMMVYVFNCSEQMDYKSIGNIYKGLVQTGAWGCFDEFNRISVEVLSVVAVQVKMIHDAIRNRKKRFVFLGEAITLKPSVGIFITMNPGYAGRTELPENLKALFRPCAMVAPDIELICEILLVAEGFVDARALARKFITLYTLCKELLSKQDHYDWGLRAIKSVLVVAGSLKRGDKNRPEDQVLMRALRDFNMPKIVTDDIPVFLGLVGDLFPALDVPRRRKLHFEQMVRQSTLELRLQPEESFILKVVQLEELLAVRHSVFVVGNAGTGKSKILRTLNRTYVNMKQKPVWNDLNPKAVTTDELFGFIHHATREWKDGKIVYSYFIGLFSSILREQANLKHDGPKWIVLDGDIDPMWIESLNTVMDDNKVLTLASNERIALTPFMRLLFEIHHLRSATPATVSRAGILYVNPQDLGWNPYVASWIDRRRHQSEKANLTILFDKYVPACLDKLRTSFKTITSIPESSLVQTLCVLLECLLTPENVPSDSPKEVYEVYFVFACIWAFGGTLLQDQISDYQADFSRWWQKEMKAVKFPSQGTIFDYYVDHKTKKLLPWADKIAQFTMDPDVPLQTVLVHTTETARLRYFMELLLEKGKPLMLVGNAGVGKTVFVGDTLASLSEDYIVSRVPFNYYTTSTALQKILEKPLEKKAGHNYGPGGNKKLIYFIDDMNMPEVDLYGTVQPHTLIRQHIDYGHWYDRQKVMLKEIHNCQYVACMNPMVGSFTINPRLQRHFTVFAFNFPSLDALNTIYGQIFSFHFQQQAFAPSILRSGPTLIQATIAFHQTMMCNFLPTAIKFHYIFNLRDLSNVFQGILFASPECLKGPLDLIHLWLHESARVYGDKLIDKKDCDLFQRRMLETAYKYFEGIDSHMLLQQPLIYCHFADRGKDPHYMPVKDWEVLKTILTETLDNYNELNAAMHLVLFEDAMQHVCRISRILRTPQGCALLVGVGGSGKQSLSRLAAYLRGLEVFQITLTEGYGIQELRVDLANLYIRTGAKNMPTVFLLTDAQVLDESFLVLINDLLASGEIPDLFSDEDVDKIISGIHNEVHALGMVDSRENCWKFFMARVRLQLKIILCFSPVGRTLRVRARKFPAIVNCTAIDWFHAWPQEALVSVSRRFIEETKGIEPVHKDSISLFMAHVHTTVNEMSTRYYQNERRHNYTTPKSFLEQISLFKNLLKKKQNEVSEKKERLVNGIQKLKTTASQVGDLKARLASQEAELQLRNHDAEALITKIGLQTEKVSREKTIADAEERKVTAIQTEVFQKQRECEADLLKAEPALVAATAALNTLNRVNLSELKAFPNPPIAVTNVTAAVMVLLAPRGRVPKDRSWKAAKVFMGKVDDFLQALINYDKEHIPENCLKVVNEHYLKDPEFNPNLIRTKSFAAAGLCAWVINIIKFYEVYCDVEPKRQALAQANLELAAATEKLEAIRKKLVDLDRNLSRLTASFEKATAEKVRCQEEVNQTNKTIKLANRLVKELEAKKIRWGQSIKSFEAQEKTLCGDVLLTAAFVSYVGPFTRQYRQELVHCKWVPFLQQKVSIPLTEGLDLISMLTDDATIAAWNNEGLPSDRMSTENAAILTHCERWPLVIDPQQQGIKWIKNKYGMDLKVTHLGQKGFLNAIETALAFGDVILIENLEETIDPVLDPLLGRNTIKKGKYIRIGDKECEFNKNFRLILHTKLANPHYKPELQAQTTLLNFTVTEDGLEAQLLAEVVSIERPDLEKLKLVLTKHQNDFKIELKYLEDDLLLRLSAAEGSFLDDTKLVERLEATKTTVAEIEHKVIEAKENERKINEARECYRPVAARASLLYFVINDLQKINPLYQFSLKAFNVLFHRAIEQADKVEDMQGRISILMESITHAVFLYTSQALFEKDKLTFLSQMAFQILLRKKEIDPLELDFLLRFTVEHTHLSPVDFLTSQSWSAIKAIAVMEEFRGIDRDVEGSAKQWRKWVESECPEKEKLPQEWKKKSLIQKLILLRAMRPDRMTYALRNFVEEKLGAKYVERTRLDLVKAFEESSPATPIFFILSPGVDALKDLEILGKRLGFTIDSGKFHNVSLGQGQETVAEVALEKASKGGHWVILQNVHLVAKWLGTLEKLLERFSQGSHRDYRVFMSAESAPTPDEHIIPQGLLENSIKITNEPPTGMLANLHAALYNFDQDTLEICSKEQEFKSILFSLCYFHACVAGRLRFGPQGWSRSYPFNPGDLTICASVLYNYLEANSKVPWEDLRYLFGEIMYGGHITDDWDRKLCRVYLEEFMNPSLTEDELMLAPGFAAPPYLDYAGYHQYIEEMLPPESPALYGLHPNAEIEFLTVTSNTLFRTLLEMQPRNALSGDELGQSTEEKVKNVLDDILEKLPEEFNMAEIMQKNSNRSPYVLVCFQECERMNILIREIRISLEQLDLSLKGELALSPAVEAQQFALSYDTVPDTWSKLAYPSTYGLAQWFNDLLLRCRELDTWTQDLTLPAVVWLSGFFNPQSFLTAIMQTMARKNEWPLDKTRLTADVTKKTKEDYGHPPREGAYLHGLFMEGARWDTQAGTIVEARLKELACPMPVIFAKATPVDRQETKQTYECPVYRTKLRGPSYIWTFRLKSEEKTAKWVLAGVALLLEA

SEQ ID NO: 26055 - protein, 3092 aa, Homo sapiens
  Payload ID: 5153
  Gene Symbol: DNAH12
  Gene Name: dynein, axonemal, heavy chain 12
  Uniprot ID: Q6ZR08
  ENSP ID: ENSP00000295937
MSDANKAAIAAEKEALNLKLPPIVHLPENIGVDTPTQSKLLKYRRSKEQQQKINQLVIDGAKRNLDRTLGKRTPLLPPPDYPQTMTSEMKKKGFNYIYMKQCVESSPLVPIQQEWLDHMLRLIPESLKEGKEREELLESLINEVSSDFENSMKRYLVQSVLVKPPVKSLEDEGGPLPESPVGLDYSNPWHSSYVQARNQIFSNLHIIHPTMKMLLDLGYTTFADTVLLDFTGIRAKGPIDCESLKTDLSIQTRNAEEKIMNTWYPKVINLFTKKEALEGVKPEKLDAFYSCVSTLMSNQLKDLLRRTVEGFVKLFDPKDQQRLPIFKIELTFDDDKMEFYPTFQDLEDNVLSLVERIAEALQNVQTIPSWLSGTSTPVNLDTELPEHVLHWAVDTLKAAVHRNLEGARKHYETYVEKYNWLLDGTAVENIETFQTEDHTFDEYTEFIEKFLSLASEIMLLPQWIHYTMVRLDCEDLKTGLTNKAKAFANILLNDIASKYRKENECICSEFEAIKEHALKVPETTEEMMDLISYVEKARTVGIEELILRIQESKRQMSYFLDVFLFPQEDLALNATVLMWPRKINPIFDENDELIENAKHKKENELMAKREKLILEIEKESRRMEEFTEFAELERMQQYVTDVRQLQKRIQESEEAVQFINKEEELFKWELTKYPELDKLKVNIEPYQKFFNFVLKWQRSEKRWMDGGFLDLNGESMEADVEEFSREIFKTLKFFQTKLKKELQEKRKAARKRSLEEEKIEEEPKDNATITMCRMRARHWKQISEIVGYDLTPDSGTTLRKVLKLNLTPYLEQFEVISAGASKEFSLEKAMNTMIGTWEDIAFHISLYRDTGVCILSSVDEIQAILDDQIIKTQTMRGSPFIKPFEHEIKAWEDRLIRIQETIDEWLKVQAQWLYLEPIFCSEDIMQQMPEEGRQFQTVDRHWRDIMKFCAKDPKVLAATSLTGLLEKLQNCNELLEKIMKGLNAYLEKKRLFFPRFFFLSNDEMLEILSETKDPLRVQPHLKKCFEGIAKLEFLPNLDIKAMYSSEGERVELIALISTSAARGAVEKWLIQVEDLMLRSVHDVIAAARLAYPESARRDWVREWPGQVVLCISQMFWTSETQEVISGGTEGLKKYYKELQNQLNEIVELVRGKLSKQTRTTLGALVTIDVHARDVVMDMIKMGVSHDTDFLWLAQLRYYWENENARVRIINCNVKYAYEYLGNSPRLVITPLTDRCYRTLIGAFYLNLGGAPEGPAGTGKTETTKDLAKALAVQCVVFNCSDGLDYLAMGKFFKGLASSGAWACFDEFNRIELEVLSVVAQQILCIQRAIQQKLVVFVFEGTELKLNPNCFVAITMNPGYAGRSELPDNLKVLFRTVAMMVPNYALIAEISLYSYGFLNARPLSVKIVMTYRLCSEQLSSQFHYDYGMRAVKAVLVAAGNLKLKYPNENEDILLLRSIKDVNEPKFLSHDIPLFNGITSDLFPGIKLPEADYHEFLECAHEACNVHNLQPVKFFLEKIIQTYEMMIVRHGFMLVGEPFAAKTKVLHVLADTLTLMNEHGYGEEEKVIYRTVNPKSITMGQLFGQFDPVSHEWTDGIVANTFREFALSETPDRKWVVFDGPIDTLWIESMNTVLDDNKKLCLMSGEIIQMSPQMSLIFETMDLSQASPATVSRCGMIYLEPSQLGWEPLVSSWLNSLKGPLCEPEYQALLRGLFAWLIPPSLNQRVELFQLNYLYTTIVSKILKILITFRISNYFKYVPLKTQCTFIKFFLHQQACFIFSLIWSIGGSCDTDGRRVFDTFIRLIILGKDDENPVPDSVGKWECPFDEKGLVYDYMYELKNKGRWVHWNELIKNTNLGDKQIKIQDIIVPTMDTIRYTFLMDLSITYAKPLLFVGPTGTGKSVYVKDKLMNHLEKDQYFPFYINLSARTSANQVQNIIMARLDKRRKGVFGPPMGKKCIIFIDDMNMPALEKYGAQPPIELLRQFFDCGHWYDLKDTSKITLVDIELIAAMGPPGGGRNPVTPRCIRHFNICSINSFSDETMVRIFSSIVAFYLRTHEFPPEYFVIGNQIVNGTMEIYKQSVENLLPTPTKSHYTFNLRDFSRVIRGCLLIERDAVANKHTMIRLFVHEVLRVFYDRLINDDDRRWLFQLTKTVIKDHFKESFHSIFSHLRKQNAPVTEEDLRNLMFGDYMNPDLEGDDRVYIEIPNIHHFSDVVDQCLDEYNQTHKTRMNLVIFRYVLEHLSRICRVLKQSGGNALLVGLGGSGRQSLTRLATSMAKMHIFQPEISKSYGMNEWREDMKSFIAVPVTNRIVDNKSKILEKRLRYLNDHFTYNLYCNICRSLFEKDKLLFSFLLCANLLLARKEIEYQELMFLLTGGVSLKSAEKNPDPTWLQDKSWEEICRASEFPAFRGLRQHFCEHIYEWREIYDSKEPHNAKFPAPMDKNLNELQKIIILRCLRPDKITPAITNYVTDKLGKKFVEPPPFDLTKSYLDSNCTIPLIFVLSPGADPMASLLKFANDKSMSGNKFQAISLGQGQGPIAAKMIKAAIEEGTWVCLQNCHLAVSWMPMLEKICEDFTSETCNSSFRLWLTSYPSSKFPVTILQNGVKMTNEPPTGLRLNLLQSYLTDPVSDPEFFKGCRGKELAWEKLLFGVCFFHALVQERKKFGPLGWNIPYGFNESDLRISIRQLQLFINEYDTIPFEAISYLTGECNYGGRVTDDWDRRLLLTMLADFYNLYIVENPHYKFSPSGNYFAPPKGTYEDYIEFIKKLPFTQHPEIFGLHENVDISKDLQQTKTLFESLLLTQGGSKQTGASGSTDQILLEITKDILNKLPSDFDIEMALRKYPVRYEESMNTVLVQEMERFNNLIITIRNTLRDLEKAIKGVVVMDSALEALSGSLLVGKVPEIWAKRSYPSLKPLGSYITDFLARLNFLQDWYNSGKPCVFWLSGFFFTQAFLTGAMQNYARKYTTPIDLLGYEFEVIPSDTSDTSPEDGVYIHGLYLDGARWDRESGLLAEQYPKLLFDLMPIIWIKPTQKSRIIKSDAYVCPLYKTSERKGTLSTTGHSTNFVIAMLLKTDQPTRHWIKRGVALLCQLDD

SEQ ID NO: 26056 - protein, 457 aa, Homo sapiens
  Payload ID: 5153
  Gene Symbol: DNAH12
  Gene Name: dynein, axonemal, heavy chain 12
  Uniprot ID: Q6ZR08
  ENSP ID: ENSP00000312554
MSDANKAAIAAEKEALNLKLPPIVHLPENIGVDTPTQSKLLKYRRSKEQQQKINQLVIDGAKRNLDRTLGKRTPLLPPPDYPQTMTSEMKKKGFNYIYMKQCVESSPLVPIQQEWLDHMLRLIPESLKEGKEREELLESLINEVSSDFENSMKRYLVQSVLVKPPVKSLEDEGGPLPESPVGLDYSNPWHSSYVQARNQIFSNLHIIHPTMKMLLDLGYTTFADTVLLDFTGIRAKGPIDCESLKTDLSIQTRNAEEKIMNTWYPKVINLFTKKEALEGVKPEKLDAFYSCVSTLMSNQLKDLLRRTVEGFVKLFDPKDQQRLPIFKIELTFDDDKMEFYPTFQDLEDNVLSLVERIAEALQNVQTIPSWLSGTSTPVNLDTELPEHVLHWAVDTLKAAVHRNLEGARKHYETYVEKYNWLLDGTAVENIETFQTEDHTFDEYTEELDCWVVWEVYF

SEQ ID NO: 26057 - protein, 784 aa, Homo sapiens
  Payload ID: 5153
  Gene Symbol: DNAH12
  Gene Name: dynein, axonemal, heavy chain 12
  ENSP ID: ENSP00000374187
MSDANKAAIAAEKEALNLKLPPIVHLPENIGVDTPTQSKLLKYRRSKEQQQKINQLVIDGAKRNLDRTLGKRTPLLPPPDYPQTMTSEMKKKGFNYIYMKQCVESSPLVPIQQEWLDHMLRLIPESLKEGKEREELLESLINEVSSDFENSMKRYLVQSVLVKPPVKSLEDEGGPLPESPVGLDYSNPWHSSYVQARNQIFSNLHIIHPTMKMLLDLGYTTFADTVLLDFTGIRAKGPIDCESLKTDLSIQTRNAEEKIMNTWYPKVINLFTKKEALEGVKPEKLDAFYSCVSTLMSNQLKDLLRRTVEGFVKLFDPKDQQRLPIFKIELTFDDDKMEFYPTFQDLEDNVLSLVERIAEALQNVQTIPSWLSGTSTPVNLDTELPEHVLHWAVDTLKAAVHRNLEGARKHYETYVEKYNWLLDGTAVENIETFQTEDHTFDEYTEFIEKFLSLASEIMLLPQWIHYTMVRLDCEDLKTGLTNKAKAFANILLNDIASKYRKENECICSEFEAIKEHALKVPETTEEMMDLISYVEKARTVGIEELILRIQESKRQMSYFLDVFLFPQEDLALNATVLMWPRKINPIFDENDELIENAKHKKENELMAKREKLILEIEKESRRMEEFTEFAELERMQQYVTDVRQLQKRIQESEEAVQFINKEEELFKWELTKYPELDKLKVNIEPYQKFFNFVLKWQRSEKRWMDGGFLDLNGESMEADVEEFSREIFKTLKFFQTKLKKELQEKRKAARKRSLEEEKIEEEPKDNATITMCSTVMEQIKAFKV

SEQ ID NO: 26058 - protein, 3960 aa, Homo sapiens
  Payload ID: 5153
  Gene Symbol: DNAH12
  Gene Name: dynein, axonemal, heavy chain 12
  ENSP ID: ENSP00000418137
MSDANKAAIAAEKEALNLKLPPIVHLPENIGVDTPTQSKLLKYRRSKEQQQKINQLVIDGAKRNLDRTLGKRTPLLPPPDYPQTMTSEMKKKGFNYIYMKQCVESSPLVPIQQEWLDHMLRLIPESLKEGKEREELLESLINEVSSDFENSMKRYLVQSVLVKPPVKSLEDEGGPLPESPVGLDYSNPWHSSYVQARNQIFSNLHIIHPTMKMLLDLGYTTFADTVLLDFTGIRAKGPIDCESLKTDLSIQTRNAEEKIMNTWYPKVINLFTKKEALEGVKPEKLDAFYSCVSTLMSNQLKDLLRRTVEGFVKLFDPKDQQRLPIFKIELTFDDDKMEFYPTFQDLEDNVLSLVERIAEALQNVQTIPSWLSGTSTPVNLDTELPEHVLHWAVDTLKAAVHRNLEGARKHYETYVEKYNWLLDGTAVENIETFQTEDHTFDEYTEFIEKFLSLASEIMLLPQWIHYTMVRLDCEDLKTGLTNKAKAFANILLNDIASKYRKENECICSEFEAIKEHALKVPETTEEMMDLISYVEKARTVGIEELILRIQESKRQMSYFLDVFLFPQEDLALNATVLMWPRKINPIFDENDELIENAKHKKENELMAKREKLILEIEKESRRMEEFTEFAELERMQQYVTDVRQLQKRIQESEEAVQFINKEEELFKWELTKYPELDKLKVNIEPYQKFFNFVLKWQRSEKRWMDGGFLDLNGESMEADVEEFSREIFKTLKFFQTKLKKELQEKRKAARKRSLEEEKIEEEPKDNATITMCSTVMEQIKAFKEYIPTVSILCNPGMRARHWKQISEIVGYDLTPDSGTTLRKVLKLNLTPYLEQFEVISAGASKEFSLEKAMNTMIGTWEDIAFHISLYRDTGVCILSSVDEIQAILDDQIIKTQTMRGSPFIKPFEHEIKAWEDRLIRIQETIDEWLKVQAQWLYLEPIFCSEDIMQQMPEEGRQFQTVDRHWRDIMKFCAKDPKVLAATSLTGLLEKLQNCNELLEKIMKGLNAYLEKKRLFFPRFFFLSNDEMLEILSETKDPLRVQPHLKKCFEGIAKLEFLPNLDIKAMYSSEGERVELIALISTSAARGAVEKWLIQVEDLMLRSVHDVIAAARLAYPESARRDWVREWPGQVVLCISQMFWTSETQEVISGGTEGLKKYYKELQNQLNEIVELVRGKLSKQTRTTLGALVTIDVHARDVVMDMIKMGVSHDTDFLWLAQLRYYWENENARVRIINCNVKYAYEYLGNSPRLVITPLTDRCYRTLIGAFYLNLGGAPEGPAGTGKTETTKDLAKALAVQCVVFNCSDGLDYLAMGKFFKGLASSGAWACFDEFNRIELEVLSVVAQQILCIQRAIQQKLVVFVFEGTELKLNPNCFVAITMNPGYAGRSELPDNLKVLFRTVAMMVPNYALIAEISLYSYGFLNARPLSVKIVMTYRLCSEQLSSQFHYDYGMRAVKAVLVAAGNLKLKYPNENEDILLLRSIKDVNEPKFLSHDIPLFNGITSDLFPGIKLPEADYHEFLECAHEACNVHNLQPVKFFLEKIIQTYEMMIVRHGFMLVGEPFAAKTKVLHVLADTLTLMNEHGYGEEEKVIYRTVNPKSITMGQLFGQFDPVSHEWTDGIVANTFREFALSETPDRKWVVFDGPIDTLWIESMNTVLDDNKKLCLMSGEIIQMSPQMSLIFETMDLSQASPATVSRCGMIYLEPSQLGWEPLVSSWLNSLKGPLCEPEYQALLRGLFAWLIPPSLNQRKKKCKELIPTSNSNVVVSLTRLFEVLLCNVVENDPTSKHIRVWIMACFIFSLIWSIGGSCDTDGRRVFDTFIRLIILGKDDENPVPDSVGKWECPFDEKGLVYDYMYELKNKGRWVHWNELIKNTNLGDKQIKIQDIIVPTMDTIRYTFLMDLSITYAKPLLFVGPTGTGKSVYVKDKLMNHLEKDQYFPFYINLSARTSANQVQNIIMARLDKRRKGVFGPPMGKKCIIFIDDMNMPALEKYGAQPPIELLRQFFDCGHWYDLKDTSKITLVDIELIAAMGPPGGGRNPVTPRCIRHFNICSINSFSDETMVRIFSSIVAFYLRTHEFPPEYFVIGNQIVNGTMEIYKQSVENLLPTPTKSHYTFNLRDFSRVIRGCLLIERDAVANKHTMIRLFVHEVLRVFYDRLINDDDRRWLFQLTKTVIKDHFKESFHSIFSHLRKQNAPVTEEDLRNLMFGDYMNPDLEGDDRVYIEIPNIHHFSDVVDQCLDEYNQTHKTRMNLVIFRYVLEHLSRICRVLKQSGGNALLVGLGGSGRQSLTRLATSMAKMHIFQPEISKSYGMNEWREDMKGLLRNVGMKGQKTVFLITDTQIKEEAFLEDIDSVLNTGEVPNIFAADEKQEVMEGVRPVAQAGNKHDELSPLALFAFFVNRCKDNLHVVVAFSPIGDAFRNRLRQFPSLINCCTIDWFQSWPEDALERVAVKFLETLELTEVEQQEIVPICKHFHTSIMDLSERFLHELGRHNYVTATSYLELIGSFRQLLTQKRQAVMEAKQRYMNGLDKLAFAESQVGEMQMELVELQPKLEEAKIENANMMQVIEIESVQVEAKRQFVKLDEEIASGKAEEAQALKNECESDLAEAIPALEAALSALDTLKPADITIVKSMKNPPSGVKLVMAAVCVMKDIKPEKISDPSGTGGKILDYWGPSKKLLGDMNFLRDLKEYDKDNIPVTVMQKIRSEYLMNPEFDPPKVAKASSAAEGLCKWIMAMEVYDRVAKVVAPKKARLSEAQKSLAETMELLNQKRAELAEVEHHLENLQMTFLEKTEEKAALEDQVELCAKKLERASQLIGGLGGEKSRWAQAADDLQITYENLTGDVLVSAGVIAYLGAFTSGFRQTCTKDWSMLCKKKKIPCSEEFLLSKTLGDPVKIRAWNIAGLPTDTFSIDNGVIVNNCRRWPLMIDPQGQANKWIKNSEKENQLSVIKLSDSDYMRTLENCIQFGTPLLLENVGEELDPSLEPLLLRQTFKQGGIDCIRLGEVIIEYSFDFKFYITTKLRNPHYMPELATKVSLLNFMITPEGLEDQLLGIVVAKERPELEEERNALILQSAANKKQLKDIEKKILETLSSSEGNILEDESAIKVLDSAKMMSNEITKKQQIAEKTELKIAESREGYRPIAKHSSVLFFSIADLANIDPMYQYSLTWFVNLYINSIHDSNKSKILEKRLRYLNDHFTYNLYCNICRSLFEKDKLLFSFLLCANLLLARKEIEYQELMFLLTGGVSLKSAEKNPDPTWLQDKSWEEICRASEFPAFRGLRQHFCEHIYEWREIYDSKEPHNAKFPAPMDKNLNELQKIIILRCLRPDKITPAITNYVTDKLGKKFVEPPPFDLTKSYLDSNCTIPLIFVLSPGADPMASLLKFANDKSMSGNKFQAISLGQGQGPIAAKMIKAAIEEGTWVCLQNCHLAVSWMPMLEKICEDFTSETCNSSFRLWLTSYPSSKFPVTILQNGVKMTNEPPTGLRLNLLQSYLTDPVSDPEFFKGCRGKELAWEKLLFGVCFFHALVQERKKFGPLGWNIPYGFNESDLRISIRQLQLFINEYDTIPFEAISYLTGECNYGGRVTDDWDRRLLLTMLADFYNLYIVENPHYKFSPSGNYFAPPKGTYEDYIEFIKKLPFTQHPEIFGLHENVDISKDLQQTKTLFESLLLTQGGSKQTGASGSTDQILLEITKDILNKLPSDFDIEMALRKYPVRYEESMNTVLVQEMERFNNLIITIRNTLRDLEKAIKGVVVMDSALEALSGSLLVGKVPEIWAKRSYPSLKPLGSYITDFLARLNFLQDWYNSGKPCVFWLSGFFFTQAFLTGAMQNYARKYTTPIDLLGYEFEVIPSDTSDTSPEDGVYIHGLYLDGARWDRESGLLAEQYPKLLFDLMPIIWIKPTQKSRIIKSDAYVCPLYKTSERKGTLSTTGHSTNFVIAMLLKTDQPTRHWIKRGVALLCQLDD

SEQ ID NO: 26059 - protein, 740 aa, Homo sapiens
  Payload ID: 5153
  Gene Symbol: DNAH12
  Gene Name: dynein, axonemal, heavy chain 12
  ENSP ID: ENSP00000420359
  MOD_RES (1)..(1): Any amino acid
XHDSNKSKILEKRLRYLNDHFTYNLYCNICRSLFEKDKLLFSFLLCANLLLARKEIEYQELMFLLTGGVSLKSAEKNPDPTWLQDKSWEEICRASEFPAFRGLRQHFCEHIYEWREIYDSKEPHNAKFPAPMDKNLNELQKIIILRCLRPDKITPAITNYVTDKLGKKFVEPPPFDLTKSYLDSNCTIPLIFVLSPGADPMASLLKFANDKSMSGNKFQAISLGQGQGPIAAKMIKAAIEEGTWVCLQNCHLAVSWMPMLEKICEDFTSETCNSSFRLWLTSYPSSKFPVTILQNGVKMTNEPPTGLRLNLLQSYLTDPVSDPEFFKGCRGKELLFINEYDTIPFEAISYLTGECNYGGRVTDDWDRRLLLTMLADFYNLYIVENPHYKFSPSGNYFAPPKGTYEDYIEFIKKLPFTQHPEIFGLHENVDISKDLQQTKTLFESLLLTQGGSKQTGASGSTDQILLEITKDILNKLPSDFDIEMALRKYPVRYEESMNTVLVQEMERFNNLIITIRNTLRDLEKAIKGVVVMDSALEALSGSLLVGKVPEIWAKRSYPSLKPLGSYITDFLARLNFLQDWYNSGKPCVFWLSGFFFTQAFLTGAMQNYARKYTTPIDLLGYEFEVIPSDTSDTSPEDGVYIHGLYLDGARWDRESGLLAEQYPKLLFDLMPIIWIKPTQKSRIIKSDAYVCPLYKTSERKGTLSTTGHSTNFVIAMLLKTDQPTRHWIKRGVALLCQLDD

SEQ ID NO: 26060 - protein, 54 aa, Homo sapiens
  Payload ID: 5153
  Gene Symbol: DNAH12
  Gene Name: dynein, axonemal, heavy chain 12
  ENSP ID: ENSP00000420717
DFDIEMALRKYPVRYEESMNTVLVQEMERFNKTGIIQENLVCFGCQVSFSLRPF

SEQ ID NO: 26061 - protein, 1481 aa, Homo sapiens
  Payload ID: 5154
  Gene Symbol: DNAH14
  Gene Name: dynein, axonemal, heavy chain 14
  ENSP ID: ENSP00000328980
  MOD_RES (1)..(1): Any amino acid
XELFGNSSQVGINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQLLLGLLQADRTVVNSKEMAALLFVHEATRVFHDRLIDFTDKSLFYRLLSRELENCFQIQWTQENLMNHSTVFLDFLDINKTHRKKIYQNTSDYNKLASVLDEFQMKLGSISLELSHSMVFFKEAIEHIIRATRVLRQPGSHMLLIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLVEEHLLFLQAAYKDTVAEKQLLANRKTMASRRFQCASVLLTVLEDEKISRWHNQGLPHGQYSVENAILIKNGQQWPLLIDPHRQAHKWIRQMEGSRLQKLSIEDSNYTKKIENAMKTGGSVLLQNLLETLAPGLKAILKKDIYQKKGHYFIRVGDAEFEYNSNFRLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEESKSS

SEQ ID NO: 26062 - protein, 204 aa, Homo sapiens
  Payload ID: 5154
  Gene Symbol: DNAH14
  Gene Name: dynein, axonemal, heavy chain 14
  ENSP ID: ENSP00000332424
  MOD_RES (1)..(1): Any amino acid
XMLISAEGEGLVLPKKIRVRSAVEQWLVNVEKSMFDVLKKFLSQGIEDWNCQMFSQWVLSHPGQVVLTVSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLME

SEQ ID NO: 26063 - protein, 228 aa, Homo sapiens
  Payload ID: 5154
  Gene Symbol: DNAH14
  Gene Name: dynein, axonemal, heavy chain 14
  Uniprot ID: Q0VDD8
  ENSP ID: ENSP00000355813
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKRYLVICGAVYI

SEQ ID NO: 26064 - protein, 430 aa, Homo sapiens
  Payload ID: 5154
  Gene Symbol: DNAH14
  Gene Name: dynein, axonemal, heavy chain 14
  ENSP ID: ENSP00000355814
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVINIVGSVKEVELIPTLEWLSERRHYYLLRQFKIFSDFRMNKAFVTWKLNVKRIKTEKSRSFLYHHLFLADDLFQTCLVYIRGLCEDAINLKNYNDHENNLSAICLVKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIR

SEQ ID NO: 26065 - protein, 228 aa, Homo sapiens; identical to SEQ ID NO: 26063
  Payload ID: 5154
  Gene Symbol: DNAH14
  Gene Name: dynein, axonemal, heavy chain 14
  Uniprot ID: Q0VDD8
  ENSP ID: ENSP00000355815

SEQ ID NO: 26066 - protein, 453 aa, Homo sapiens
  Payload ID: 5154
  Gene Symbol: DNAH14
  Gene Name: dynein, axonemal, heavy chain 14
  Uniprot ID: Q0VDD8
  ENSP ID: ENSP00000383737
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKVINIVGSVKEVELIPTLEWLSERRHYYLLRQFKIFSDFRMNKAFVTWKLNVKRIKTEKSRSFLYHHLFLADDLFQTCLVYIRGLCEDAINLKNYNDHENNLSAICLVKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIR

SEQ ID NO: 26067 - protein, 4515 aa, Homo sapiens
  Payload ID: 5154
  Gene Symbol: DNAH14
  Gene Name: dynein, axonemal, heavy chain 14
  Uniprot ID: Q0VDD8
  ENSP ID: ENSP00000392061
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKVINIVGSVKEVELIPTLEWLSERRHYYLLRQFKIFSDFRMNKAFVTWKLNVKRIKTEKSRSFLYHHLFLADDLFQTCLVYIRGLCEDAINLKNYNDHENNLSAICLVKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIRTFKDNSFPTGKTTNDCEELVDNSKLHAISVQKSEVKTDTDINEILNSVEVGKDLRKTYAPIFEVNLCLRIPAESDSSENSKENFHESDQCPEECVMFEDEMSENKDNCVKKHSSEELLPKAKKSKEISYNLEDIISDTEIETEFENKYMYYEFPEFPTNLFIDPNRLEFSVKIQNMLTNMEKCITTITPLCQDPQLSIFIDLVSIMDLPNKTGSIIHYKEQTRWPDCHILFETDPAYQNIIVNLLTIIGNSMGLVNAYSHKFIKYCTMTEKAKIMSMKISSMGELTSKEFEAILNRFRNYFRHIVNMAIEKRIGIFNVVSLDYQSECLLYIDNVIHMSHTLIQSVIEKKNKNLLEVVESSLQQLECDPTEIEEFLEHFIFLNAISSKISKLEKEFLTMSQLYSVAKHHQIHISEEQIAIFQVLLLKFSQLKSSMKLSKINKDTAITKFRDNLEACISGLHVDVGNLKAKIRTPLLLCAGTQVSTAMEMIQTLSGEAASLTNKAKAYSHYQDCFSDSQSHMHSVNVEEITQIVLSEISDIEGDLTLRKKLWEAQEEWKRASWEWRNSSLQSIDVESVQRNVSKLMHIISVLEKGLPKSDMVTHLKQVVTEFKQELPIIIALGNPCLKPRHWEALQEIIGKSVPLDKNCKVENLLALKMFQYENEINDMSTSATNEAALEKMLFKIIDFWNTTPLPLILHHTEIYSIFIIPSIDDISAQLEESQVILATIKGSPHIGPIKDLVNEWDQNLTLFSYTLEEWMNCQRNWLYLEPVFHSSEIRRQLPAETELFSQVISMWKKIMSKIQNKQNALQITTSAGVLEILQNCNIHLEHIKKSLEDYLEVKRLIFPRFYFLSNAELLDILADSRNPESVQPHLVKCFENIKQLLIWKQDIGPPAVKMLISAEGEGLVLPKKIRVRSAVEQWLVNVEKSMFDVLKKERYIYNIILLFQSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLMEALHLNLGGCPAGPAGTGKTETVKDLAKSLGKHCVVFNCFEDLDYKIVRKFFFGLVQSGAWSCFDEFNLIDLEVLSVIASQILTIKAAKDNYSARFVLEGKEIRINMSCAVFITMNPRYGGGVELPDNLKSLFRPVAMMVPHYQMIAEIILFSFGFKSANSLSGKLTNLYELARKQLSQQDHYNFGLRSLKIVLIMAGTKKREFKCLSEADETLIVIEAIREASLPKCPPEDVPLFENIIGDIFPEVTVLKVNQLALEKVIYTATQQLGLQNWSSQKEKIIQFYNQLQVCVGVMLVGPTGGGKTTVRRILEKALTLLPIADFLSVAERKSASKISERKGKVDICVLNPKCVTLSELYGQLDPNTMEWTDGLLSATIRSYVYFNTPKNTKKDIDLRLKSRISDLSNVFKLDSSDTTETDDNIFEEIEKVVKIPENHNFDWQWIILDGPVDTFWVENLNSVLDDTRTLCLANSERIALTNKIRVIFEVDNLSQASPATVSRCAMVYMDPVDLGWEPYVKSWLLKTSKIISQSGVDCLEFMIKNSVTDGLQFIRNRQKFQPYPMEDITVVITLCRILDAFFDFMGKNGGFEQSDDLNDTSSKEANSQRESVTFKDIEKRDENTWYPEKNPDKLTKIIQKLFVFAFTWAFGGALNREDEHRENIPFCPSLEPDSLAKVTYDFDKLVHELFGNSSQVGWKHWGQSQGRRRKGNCINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQAHLGIYFSINNFTPEVQKSKDQIISCSLAIYHQVRQNMLPTPTKCHYMFNLRDMFKLLLGLLQADRTVVNSKEMAALLFVHEATRVFHDRLIDFTDKSLFYRLLSRELENCFQIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLVEEHLLFLQAAYKDTVAEKQLLANRKTMASRRFQCASVLLTVLEDEKTRWQETINQIDNKLEGILGDILLSAACIVYSGILTPEFRQLIVNKWETFCIENGISLSSKFSLIKVMAQKYEISRWHNQGLPHGQYSVENAILIKNGQQWPLLIDPHRQAHKWIRQMEGSRLQKLSIEDSNYTKKIENAMKTGGSVLLQNLLETLAPGLKAILKKDIYQKKGHYFIRVGDAEFEYNSNFRLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEETELLNENKETCNPINFPWEKLTSFQRLILVKVLRPESLNNSVRKFITEKMGNKYLQRTGVNLKDAYKGSNARTPLILIQTHGIDLTNILLRFAQELKGTTHHVTIISLGRDQAAKAEDLILKALTKTQQWVFLQNCHLATSFMPRLCTIVESFNSPNVTIDPEFRLWLSSKSYSSFPIPVLKKGLKIAVESPQGLKSNLLQTFGCTGSGEVTEEIFENPDCGQWWKKLLFSLCFFNAVINERKNYGILGWNIAYKFNSSDLGVAIKVLENSLRGQPSISWQALRYLIGEVIYGGRVIDNWDKRCLKTLLYKFCNPEVLKDDFSFSRSASIKDYIHIIQSLPDDDLPEVLGIHPEAIRSCWETQGEKFIENLIAMQPKTTTANLMIRPEQSKDELVMEILSDLLKRLPLTVEKEEIAVGTPSTLKSMMSSSIWESLSKNLKDHDPLIHCVLLTFLKQEIKRFDKLLFVIHKSLKDLQLAIKGEIILTQELEEIFNSFLNMRVPTLWQKHAYRSCKPLSSWIDDLIQRLNFFNTWAKVAYTAIQRRYMRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 26068 - protein, 299 aa, Homo sapiens
  Payload ID: 5154
  Gene Symbol: DNAH14
  Gene Name: dynein, axonemal, heavy chain 14
  ENSP ID: ENSP00000398678
  MOD_RES (1)..(1): Any amino acid
XTGVSHRADGERGTVGINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISP

SEQ ID NO: 26069 - protein, 3507 aa, Homo sapiens
  Payload ID: 5154
  Gene Symbol: DNAH14
  Gene Name: dynein, axonemal, heavy chain 14
  Uniprot ID: Q0VDD8
  ENSP ID: ENSP00000409472
MGRRSQWIWAMRCQMLVPVLSLHIGLARALGCGCIASKIECLIRCNAPFPLLDAVGSVASQELQSLTGTVGVTSGAAAYPRWNLARARAPPHLPGTQDPLRRVRDPTPIVASSPGRRRGSWSGGYGQEASEPGVVGLCCAVLPIHPSLALAGVGGPDLRRFQEGPQRPSDHGAAEKHMETFIPIDLTTENQEMDKEETKTKPRLLRYEEKKYEDVKPLETQPAEIAEKETLEYKTVRTFSESLKSEKTEEPKDDDVIRNIIRLREKLGWQTILPQHSLKYGSSKIAIQKITLKKPLEDDGEFVYCLPRKSPKSLYNPYDLQVVSAHTAKHCKEFWVITASFISKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIRTFKDNSFPTGKTTNDCEELVDNSKLHAISVQKSEVKTDTDINEILNSVEVGKDLRKTYAPIFEVNLCLRIPAESDSSENSKENFHESDQCPEECVMFEDEMSENKDNCVKKHSSEELLPKAKKSKEISYNLEDIISATITPLCQDPQLSIFIDLVSIMDLPNKTGSIIHYKEQTRWPDCHILFETDPAYQNIIVNLLTIIGNSMGLVNAYSHKFIKYCTMTEKAKIMSMKISSMGELTSKEFEAILNRFRNYFRHIVNMAIEKRIGIFNVVVESSLQQLECDPTEIEEFLEHFIFLNAISSKISKLEKEFLTMSQLYSVAKHHQIHISEEQIAIFQVLLLKFSQLKSSMKLSKINKDTAITKFRDNLEACISGLHVDVGNLKAKIRTPLLLCAGTQVSTAMEMIQTLSGEAASLTNKAKAYSHYQDCFSDSQSHMHSVNVEEITQIVLSEISDIEGDLTLRKKLWEAQEEWKRASWEWRNSSLQSIDVESVQRNVSKLMHIISVLEKEIYSIFIIPSIDDISAQLEESQVILATIKGSPHIGPIKSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLMEALHLNLGGCPAGPAGTGKTETVKDLAKCALFAFKCNTALIKLPNSLIVLTCFGLEKTVLVMNTVMSFRFVLEGKEIRINMSCAVFITMNPRYGGGVELPDNLKSLFRPVAMMVPHYQMIAEIILFSFGFKSANSLSGKLTNLYELARKQLSQQDHYNFGLRSLKIVLIMAGTKKREFKCDTSDSLSEADETLIVIEAIREASLPKCPPEDVPLFENIIGDIFPEVTVLKVNQLALEKVIYTATQQLGLQNWSSQKEKIIQFYNQLQVCVGVMLVGPTGGGKTTVRRILEKALTLLPIADFLSVAERKSASKISERKGKVDICVLNPKCVTLSELYGQLDPNTMEWTDGLLSATIRSYVYFNTPKNTKKDIDLRLKSRISDLSNVFKLDSSDTTETDDNIFEEIEKVVKIPENHNFDWQWIILDGPVDTFWVENLNSVLDDTRTLCLANSERIALTNKIRVIFEVDNLSQASPATVSRCAMVYMDPVDLGWEPYVKSWLLKTSKIISQSGVDCLEFMIKNSVTDGLQFIRNRQKFQPYPMEDITVVITLCRILDAFFDFMGKNGGFEQSDDLNDTSSKEANSQRESVTFKDIEKRDENTWYPEKNPDKLTKIIQKLFVFAFTWAFGGALNREDEHRENIPFCPSLEPDSLAKVTYDFDKLVHELFGNSSQVGINLPTGECSIFGYFVDIEQCEFIPWSDLVPNDQTLIQRDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLISRWHNQGLPHGQYSVENAILIKNGQQWPLLIDPHRQAHKWIRQMEGSRLQKLSIEDSNYTKKIENAMKTGGSVLLQSCQASTWRKKLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEEKHTFCLLLRAINHTGTDLGPVGRGQWLTSTACDRHTDVCSFSFALNDGVPDVEHVQDIFYGHCVDKYHVKVLRPESLNNSVRKFITEKMGNKYLQRTGVNLKDAYKGSNARTPLILIQTHGSASIKDYIHIIQSLPDDDLPEVLGIHPEAIRSCWETQGEKFIENLIAMQPKTTTANLMIRPEQSKDELVMEILSDLLKRLPLTVEKEEIAVGTPSTLKSMMSSSIWESLSKNLKDHDPLIHCVLLTFLKQEIKRFDKLLFVIHKSLKDLQLAIKGEIILTQELEEIFNSFLNMRVPTLWQKHAYRSCKPLSSWIDDLIQRLNFFNTWAKVAYTAIQRRYMRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 26070 - protein, 126 aa, Homo sapiens
  Payload ID: 5154
  Gene Symbol: DNAH14
  Gene Name: dynein, axonemal, heavy chain 14
  ENSP ID: ENSP00000409971
  MOD_RES (1)..(1): Any amino acid
XLEYKTVRTFSESLKSEKTEEPKDDDVIRNIIRLREKLGWQTILPQHSLKYGSSKIAIQKITLKKPLEDDGEFVYCLPRKSPKSLYNPYDLQVVSAHTAKHCKEFWVITASFISKRYLVICGAVYI

SEQ ID NO: 26071 - protein, 4515 aa, Homo sapiens; identical to SEQ ID NO: 26067
  Payload ID: 5154
  Gene Symbol: DNAH14
  Gene Name: dynein, axonemal, heavy chain 14
  Uniprot ID: Q0VDD8
  ENSP ID: ENSP00000414402

SEQ ID NO: 26072 - protein, 219 aa, Homo sapiens
  Payload ID: 5154
  Gene Symbol: DNAH14
  Gene Name: dynein, axonemal, heavy chain 14
  ENSP ID: ENSP00000414699
  MOD_RES (1)..(1): Any amino acid
XRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 26073 - protein, 68 aa, Homo sapiens
  Payload ID: 5154
  Gene Symbol: DNAH14
  Gene Name: dynein, axonemal, heavy chain 14
  ENSP ID: ENSP00000429122
AEGEGLVLPKKIRVRSAVEQWLVNVEKSMFDVLKKFLSQGIEDWNCQMFSQWVLSHPGQVVLTVTFAI

SEQ ID NO: 26074 - protein, 130 aa, Homo sapiens
  Payload ID: 5154
  Gene Symbol: DNAH14
  Gene Name: dynein, axonemal, heavy chain 14
  ENSP ID: ENSP00000429568
DYLEVKRLIFPRFYFLSNAELLDILADSRNPESVQPHLVKCFENIKQLLIWKQDIGPPAVKMLISAEGEGLVLPKYDKCYKLFRFCTTSLFKISALKFLIYYKSALSKLFLQRLYPYVNILLPFHIPYNT

SEQ ID NO: 26075 - protein, 4462 aa, Homo sapiens
  Payload ID: 5155
  Gene Symbol: DNAH17
  Gene Name: dynein, axonemal, heavy chain 17
  Uniprot ID: Q9UFH2
  ENSP ID: ENSP00000374490
MTMAPDVRLEYLEEVASIVLKFKPDKWSKLIGAEENVALFTEFFEKPDVQVLVLTLNAAGMIIPCLGFPQSLKSKGVYFIKTKSENINKDNYRARLLYGDISPTPVDQLIAVVEEVLSSLLNQSENMAGWPQVVSEDIVKQVHRLKNEMFVMSGKIKGKTLLPIPEHLGSLDGTLESMERIPSSLDNLLLHAIETTIIDWSHQIRDVLSKDSAQALLDGLHPLPQVEFEFWDTRLLNLKCIHEQLNRPKVNKIVEILEKAKSCYWPALQNVYTNVTEGLKEANDIVLYLKPLRILLEEMEQADFTMLPTFIAKVLDTICFIWATSEYYNTPARIIVILQEFCNQIIEMTRTFLSPEEVLKGLQGEIEEVLSGISLAVNVLKELYQTYDFCCVNMKLFFKDKEPVPWEFPSSLAFSRINSFFQRIQTIEELYKTAIEFLKLEKIELGGVRGNLLGSLVTRIYDEVFELVKVFADCKYDPLDPGDSNFDRDYADFEIKIQDLDRRLATIFCQGFDDCSCIKSSAKLLYMCGGLMERPLILAEVAPRYSVMLELFDAELDNAKILYDAQMAASEEGNIPLIHKNMPPVAGQLKWSLELQERLEVSMKHLKHVEHPVMSGAEAKLTYQKYDEMMELLRCHREKIYQQWVAGVDQDCHFNLGQPLILRDAASNLIHVNFSKALVAVLREVKYLNFQQQKEIPDSAESLFSENETFRKFVGNLELIVGWYNEIKTIVKAVEFLLIKSELEAIDVKLLSAETTLFWNGEGVFQYIQEVREILHNLQNRMQKAKQNIEGISQAMKDWSANPLFERKDNKKEALLDLDGRIANLNKRYAAVRDAGVKIQAMVAENAELFRADTLSLPWKDYVIYIDDMVLDEFDQFIRKSLSFLMDNMVIDESIAPLFEIRMELDEDGLTFNPTLEVGSDRGFLALIEGLVNDIYNVARLIPRLAKDRMNYKMDLEDNTDLIEMREEVSSLVINAMKEAEEYQDSFERYSYLWTDNLQEFMKNFLIYGCAVTAEDLDTWTDDTIPKTPPTLAQFQEQIDSYEKLYEEVSKCENTKVFHGWLQCDCRPFKQALLSTIRRWGFMFKRHLSNHVTNSLADLEAFMKVARMGLTKPLKEGDYDGLVEVMGHLMKVKERQAATDNMFEPLKQTIELLKTYGEEMPEEIHLKLQELPEHWANTKKLAIQVKLTVAPLQANEVSILRRKCQQFELKQHEFRERFRREAPFSFSDPNPYKSLNKQQKSISAMEGIMEALSKSGGLFEVPVPDYKQLKACHREVRLLKELWDMVVVVNTSIEDWKTTKWKDINVEQMDIDCKKFAKDMRSLDKEMKTWDAFVGLDNTVKNVITSLRAVSELQNPAIRERHWQQLMQATQVKFKMSEETTLADLLQLNLHSYEDEVRNIVDKAVKESGMEKVLKALDSTWSMMEFQHEPHPRTGTMMLKSSEVLVETLEDNQVQLQNLMMSKYLAHFLKEVTSWQQKLSTADSVISIWFEVQRTWSHLESIFIGSEDIRTQLPGDSQRFDDINQEFKALMEDAVKTPNVVEATSKPGLYNKLEALKKSLAICEKALAEYLETKRLAFPRFYFVSSADLLDILSNGNDPVEVSRHLSKLFDSLCKLKFRLDASDKPLKVGLGMYSKEDEYMVFDQECDLSGQVEVWLNRVLDRMCSTLRHEIPEAVVTYEEKPREQWILDYPAQVALTCTQIWWTTEVGLAFARLEEGYENAIRDYNKKQISQLNVLITLLMGNLNAGDRMKIMTICTIDVHARDVVAKMIVAKVESSQAFTWQAQLRHRWDEEKRHCFANICDAQIQYSYEYLGNTPRLVITPLTDRCYITLTQSLHLIMGGAPAGPAGTGKTETTKDLGRALGTMVYVFNCSEQMDYKSCGNIYKGLAQTGAWGCFDEFNRISVEVLSVIAVQVKCVQDAIRAKKKAFNFLGEIIGLIPTVGIFITMNPGYAGRAELPENLKALFRPCAMVVPDFELICEIMLMAEGFLEARLLARKFITLYTLCKELLSKQDHYDWGLRAIKSVLVVAGSLKRGDPSRAEDQVLMRALRDFNIPKIVTDDLPVFMGLIGDLFPALDVPRKRDLNFEKIIKQSIVELKLQAEDSFVLKVVQLEELLQVRHSVFIVGNAGSGKSQVLKSLNKTYQNLKRKPVAVDLDPKAVTCDELFGIINPVTREWKDGLFSTIMRDLANITHDGPKWIILDGDIDPMWIESLNTVMDDNKVLTLASNERIPLNRTMRLVFEISHLRTATPATVSRAGILYINPADLGWNPVVSSWIERRKVQSEKANLMILFDKYLPTCLDKLRFGFKKITPVPEITVIQTILYLLECLLTEKTVPPDSPRELYELYFVFTCFWAFGGAMFQDQLVDYRVEFSKWWINEFKTIKFPSQGTIFDYYIDPDTKKFLPWTDKVPSFELDPDVPLQASLVHTTETIRIRYFMDLLMEKSWPVMLVGNAGTGKSVLMGDKLESLNTDNYLVQAVPFNFYTTSAMLQGVLEKPLEKKSGRNYGPPGTKKLVYFIDDMNMPEVDKYGTVAPHTLIRQHMDHRHWYDRHKLTLKDIHNCQYVACMNPTSGSFTIDSRLQRHFCVFAVSFPGQEALTTIYNTILTQHLAFRSVSMAIQRISSQLVAAALALHQKITATFLPTAIKFHYVFNLRDLSNIFQGLLFSTAEVLKTPLDLVRLWLHETERVYGDKMVDEKDQETLHRVTMASTKKFFDDLGDELLFAKPNIFCHFAQGIGDPKYVPVTDMAPLNKLLVDVLDSYNEVNAVMNLVLFEDAVAHICRINRILESPRGNALLVGVGGSGKQSLSRLAAYISGLDVFQITLKKGYGIPDLKIDLAAQYIKAAVKNVPSVFLMTDSQVAEEQFLVLINDLLASGEIPGLFMEDEVENIISSMRPQVKSLGMNDTRETCWKFFIEKVRRQLKVILCFSPVGSVLRVRARKFPAVVNCTAIDWFHEWPEDALVSVSARFLEETEGIPWEVKASISFFMSYVHTTVNEMSRVYLATERRYNYTTPKTFLEQIKLYQNLLAKKRTELVAKIERLENGLMKLQSTASQVDDLKAKLAIQEAELKQKNESADQLIQVVGIEAEKVSKEKAIADQEEVKVEVINKNVTEKQKACETDLAKAEPALLAAQEALDTLNKNNLTELKSFGSPPDAVVNVTAAVMILTAPGGKIPKDKSWKAAKIMMGKVDTFLDSLKKFDKEHIPEACLKAFKPYQGNPTFDPEFIRSKSTAAAGLCSWCINIVRFYEVYCDVAPKRQALEEANAELAEAQEKLSRIKNKIAELNANLSNLTSAFEKATAEKIKCQQEADATNRVILLANRLVGGLASENIRWAESVENFRSQGVTLCGDVLLISAFVSYVGYFTKKYRNELMEKFWIPYIHNLKVPIPITNGLDPLSLLTDDADVATWNNQGLPSDRMSTENATILGNTERWPLIVDAQLQGIKWIKNKYRSELKAIRLGQKSYLDVIEQAISEGDTLLIENIGETVDPVLDPLLGRNTIKKGKYIKIGDKEVEYHPKFRLILHTKYFNPHYKPEMQAQCTLINFLVTRDGLEDQLLAAVVAKERPDLEQLKANLTKSQNEFKIVLKELEDSLLARLSAASGNFLGDTALVENLETTKHTASEIEEKVVEAKITEVKINEARENYRPAAERASLLYFILNDLNKINPVYQFSLKAFNVVFEKAIQRTTPANEVKQRVINLTDEITYSVYMYTARGLFERDKLIFLAQVTFQVLSMKKELNPVELDFLLRFPFKAGVVSPVDFLQHQGWGGIKALSEMDEFKNLDSDIEGSAKRWKKLVESEAPEKEIFPKEWKNKTALQKLCMVRCLRPDRMTYAIKNFVEEKMGSKFVEGRSVEFSKSYEESSPSTSIFFILSPGVDPLKDVEALGKKLGFTIDNGKLHNVSLGQGQEVVAENALDVAAEKGHWVILQNIHLVARWLGTLDKKLEHYSTGSHEDYRVFISAEPAPSPETHIIPQGILENAIKITNEPPTGMHANLHKALDLFTQDTLEMCTKEMEFKCMLFALCYFHAVVAERRKFGAQGWNRSYPFNNGDLTISINVLYNYLEANPKVPWDDLRYLFGEIMYGGHITDDWDRRLCRTYLAEYIRTEMLEGDVLLAPGFQIPPNLDYKGYHEYIDENLPPESPYLYGLHPNAEIGFLTVTSEKLFRTVLEMQPKETDSGAGTGVSREEKVKAVLDDILEKIPETFNMAEIMAKAAEKTPYVVVAFQECERMNILTNEMRRSLKELNLGLKGELTITTDVEDLSTALFYDTVPDTWVARAYPSMMGLAAWYADLLLRIRELEAWTTDFALPTTVWLAGFFNPQSFLTAIMQSMARKNEWPLDKMCLSVEVTKKNREDMTAPPREGSYVYGLFMEGARWDTQTGVIAEARLKELTPAMPVIFIKAIPVDRMETKNIYECPVYKTRIRGPTYVWTFNLKTKEKAAKWILAAVALLLQV

SEQ ID NO: 26076 - protein, 4457 aa, Homo sapiens
  Payload ID: 5155
  Gene Symbol: DNAH17
  Gene Name: dynein, axonemal, heavy chain 17
  ENSP ID: ENSP00000465516
MTMAPDVRLEYLEEVASIVLKFKPDKWSKLIGAEENVALFTEFFEKPDVQVLVLTLNAAGMIIPCLGFPQSLKSKGVYFIKTKSENINKDNYRARLLYGDISPTPVDQLIAVVEEVLSSLLNQSENMAGWPQVVSEDIVKQVHRLKNEMFVMSGKIKGKTLLPIPEHLGSLDGTLESMERIPSSLDNLLLHAIETTIIDWSHQIRDVLSKDSAQALLDGLHPLPQVEFEFWDTRLLNLKCIHEQLNRPKVNKIVEILEKAKSCYWPALQNVYTNVTEGLKEANDIVLYLKPLRILLEEMEQADFTMLPTFIAKVLDTICFIWATSEYYNTPARIIVILQEFCNQIIEMTRTFLSPEEVLKGLQGEIEEVLSGISLAVNVLKELYQTYDFCCVNMKLFFKDKEPVPWEFPSSLAFSRINSFFQRIQTIEELYKTAIEFLKLEKIELGGVRGNLLGSLVTRIYDEVFELVKVFADCKYDPLDPGDSNFDRDYADFEIKIQDLDRRLATIFCQGFDDCSCIKSSAKLLYMCGGLMERPLILAEVAPRYSVMLELFDAELDNAKILYDAQMAASEEGNIPLIHKNMPPVAGQLKWSLELQERLEVSMKHLKHVEHPVMSGAEAKLTYQKYDEMMELLRCHREKIYQQWVAGVDQDCHFNLGQPLILRDAASNLIHVNFSKALVAVLREVKYLNFQQQKEIPDSAESLFSENETFRKFVGNLELIVGWYNEIKTIVKAVEFLLIKSELEAIDVKLLSAETTLFWNGEGVFQYIQEVREILHNLQNRMQKAKQNIEGISQAMKDWSANPLFERKDNKKEALLDLDGRIANLNKRYAAVRDAGVKIQAMVAENAELFRADTLSLPWKDYVIYIDDMVLDEFDQFIRKSLSFLMDNMESIAPLFEIRMELDEDGLTFNPTLEVGSDRGFLALIEGLVNDIYNVARLIPRLAKDRMNYKMDLEDNTDLIEMREEVSSLVINAMKEAEEYQDSFERYSYLWTDNLQEFMKNFLIYGCAVTAEDLDTWTDDTIPKTPPTLAQFQEQIDSYEKLYEEVSKCENTKVFHGWLQCDCRPFKQALLSTIRRWGFMFKRHLSNHVTNSLADLEAFMKVARMGLTKPLKEGDYDGLVEVMGHLMKVKERQAATDNMFEPLKQTIELLKTYGEEMPEEIHLKLQELPEHWANTKKLAIQVKLTVAPLQANEVSILRRKCQQFELKQHEFRERFRREAPFSFSDPNPYKSLNKQQKSISAMEGIMEALSKSGGLFEVPVPDYKQLKACHREVRLLKELWDMVVVVNTSIEDWKTTKWKDINVEQMDIDCKKFAKDMRSLDKEMKTWDAFVGLDNTVKNVITSLRAVSELQNPAIRERHWQQLMQATQVKFKMSEETTLADLLQLNLHSYEDEVRNIVDKAVKESGMEKVLKALDSTWSMMEFQHEPHPRTGTMMLKSSEVLVETLEDNQVQLQNLMMSKYLAHFLKEVTSWQQKLSTADSVISIWFEVQRTWSHLESIFIGSEDIRTQLPGDSQRFDDINQEFKALMEDAVKTPNVVEATSKPGLYNKLEALKKSLAICEKALAEYLETKRLAFPRFYFVSSADLLDILSNGNDPVEVSRHLSKLFDSLCKLKFRLDASDKPLKVGLGMYSKEDEYMVFDQECDLSGQVEVWLNRVLDRMCSTLRHEIPEAVVTYEEKPREQWILDYPAQVALTCTQIWWTTEVGLAFARLEEGYENAIRDYNKKQISQLNVLITLLMGNLNAGDRMKIMTICTIDVHARDVVAKMIVVESSQAFTWQAQLRHRWDEEKRHCFANICDAQIQYSYEYLGNTPRLVITPLTDRCYITLTQSLHLIMGGAPAGPAGTGKTETTKDLGRALGTMVYVFNCSEQMDYKSCGNIYKGLAQTGAWGCFDEFNRISVEVLSVIAVQVKCVQDAIRAKKKAFNFLGEIIGLIPTVGIFITMNPGYAGRAELPENLKALFRPCAMVVPDFELICEIMLMAEGFLEARLLARKFITLYTLCKELLSKQDHYDWGLRAIKSVLVVAGSLKRGDPSRAEDQVLMRALRDFNIPKIVTDDLPVFMGLIGDLFPALDVPRKRDLNFEKIIKQSIVELKLQAEDSFVLKVVQLEELLQVRHSVFIVGNAGSGKSQVLKSLNKTYQNLKRKPVAVDLDPKAVTCDELFGIINPVTREWKDGLFSTIMRDLANITHDGPKWIILDGDIDPMWIESLNTVMDDNKVLTLASNERIPLNRTMRLVFEISHLRTATPATVSRAGILYINPADLGWNPVVSSWIERRKVQSEKANLMILFDKYLPTCLDKLRFGFKKITPVPEITVIQTILYLLECLLTEKTVPPDSPRELYELYFVFTCFWAFGGAMFQDQLVDYRVEFSKWWINEFKTIKFPSQGTIFDYYIDPDTKKFLPWTDKVPSFELDPDVPLQASLVHTTETIRIRYFMDLLMEKSWPVMLVGNAGTGKSVLMGDKLESLNTDNYLVQAVPFNFYTTSAMLQGVLEKPLEKKSGRNYGPPGTKKLVYFIDDMNMPEVDKYGTVAPHTLIRQHMDHRHWYDRHKLTLKDIHNCQYVACMNPTSGSFTIDSRLQRHFCVFAVSFPGQEALTTIYNTILTQHLAFRSVSMAIQRISSQLVAAALALHQKITATFLPTAIKFHYVFNLRDLSNIFQGLLFSTAEVLKTPLDLVRLWLHETERVYGDKMVDEKDQETLHRVTMASTKKFFDDLGDELLFAKPNIFCHFAQGIGDPKYVPVTDMAPLNKLLVDVLDSYNEVNAVMNLVLFEDAVAHICRINRILESPRGNALLVGVGGSGKQSLSRLAAYISGLDVFQITLKKGYGIPDLKIDLAAQYIKAAVKNVPSVFLMTDSQVAEEQFLVLINDLLASGEIPGLFMEDEVENIISSMRPQVKSLGMNDTRETCWKFFIEKVRRQLKVILCFSPVGSVLRVRARKFPAVVNCTAIDWFHEWPEDALVSVSARFLEETEGIPWEVKASISFFMSYVHTTVNEMSRVYLATERRYNYTTPKTFLEQIKLYQNLLAKKRTELVAKIERLENGLMKLQSTASQVDDLKAKLAIQEAELKQKNESADQLIQVVGIEAEKVSKEKAIADQEEVKVEVINKNVTEKQKACETDLAKAEPALLAAQEALDTLNKNNLTELKSFGSPPDAVVNVTAAVMILTAPGGKIPKDKSWKAAKIMMGKVDTFLDSLKKFDKEHIPEACLKAFKPYQGNPTFDPEFIRSKSTAAAGLCSWCINIVRFYEVYCDVAPKRQALEEANAELAEAQEKLSRIKNKIAELNANLSNLTSAFEKATAEKIKCQQEADATNRVILLANRLVGGLASENIRWAESVENFRSQGVTLCGDVLLISAFVSYVGYFTKKYRNELMEKFWIPYIHNLKVPIPITNGLDPLSLLTDDADVATWNNQGLPSDRMSTENATILGNTERWPLIVDAQLQGIKWIKNKYRSELKAIRLGQKSYLDVIEQAISEGDTLLIENIGETVDPVLDPLLGRNTIKKGKYIKIGDKEVEYHPKFRLILHTKYFNPHYKPEMQAQCTLINFLVTRDGLEDQLLAAVVAKERPDLEQLKANLTKSQNEFKIVLKELEDSLLARLSAASGNFLGDTALVENLETTKHTASEIEEKVVEAKITEVKINEARENYRPAAERASLLYFILNDLNKINPVYQFSLKAFNVVFEKAIQRTTPANEVKQRVINLTDEITYSVYMYTARGLFERDKLIFLAQVTFQVLSMKKELNPVELDFLLRFPFKAGVVSPVDFLQHQGWGGIKALSEMDEFKNLDSDIEGSAKRWKKLVESEAPEKEIFPKEWKNKTALQKLCMVRCLRPDRMTYAIKNFVEEKMGSKFVEGRSVEFSKSYEESSPSTSIFFILSPGVDPLKDVEALGKKLGFTIDNGKLHNVSLGQGQEVVAENALDVAAEKGHWVILQNIHLVARWLGTLDKKLEHYSTGSHEDYRVFISAEPAPSPETHIIPQGILENAIKITNEPPTGMHANLHKALDLFTQDTLEMCTKEMEFKCMLFALCYFHAVVAERRKFGAQGWNRSYPFNNGDLTISINVLYNYLEANPKVPWDDLRYLFGEIMYGGHITDDWDRRLCRTYLAEYIRTEMLEGDVLLAPGFQIPPNLDYKGYHEYIDENLPPESPYLYGLHPNAEIGFLTVTSEKLFRTVLEMQPKETDSGAGTGVSREEKVKAVLDDILEKIPETFNMAEIMAKAAEKTPYVVVAFQECERMNILTNEMRRSLKELNLGLKGELTITTDVEDLSTALFYDTVPDTWVARAYPSMMGLAAWYADLLLRIRELEAWTTDFALPTTVWLAGFFNPQSFLTAIMQSMARKNEWPLDKMCLSVEVTKKNREDMTAPPREGSYVYGLFMEGARWDTQTGVIAEARLKELTPAMPVIFIKAIPVDRMETKNIYECPVYKTRIRGPTYVWTFNLKTKEKAAKWILAAVALLLQV

SEQ ID NO: 26077 - protein, 1563 aa, Homo sapiens
  Payload ID: 5155
  Gene Symbol: DNAH17
  Gene Name: dynein, axonemal, heavy chain 17
  ENSP ID: ENSP00000466150
  MOD_RES (1)..(1): Any amino acid
XEGRTEGEGKPGPARAVPAETACVTSGTRLGSRIRNLQIDLAAQYIKAAVKNVPSVFLMTDSQVAEEQFLVLINDLLASGEIPGLFMEDEVENIISSMRPQVKSLGMNDTRETCWKFFIEKVRRQLKVILCFSPVGSVLRVRARKFPAVVNCTAIDWFHEWPEDALVSVSARFLEETEGIPWEVKASISFFMSYVHTTVNEMSRVYLATERRYNYTTPKTFLEQIKLYQNLLAKKRTELVAKIERLENGLMKLQSTASQVDDLKAKLAIQEAELKQKNESADQLIQVVGIEAEKVSKEKAIADQEEVKVEVINKNVTEKQKACETDLAKAEPALLAAQEALDTLNKNNLTELKSFGSPPDAVVNVTAAVMILTAPGGKIPKDKSWKAAKIMMGKVDTFLDSLKKFDKEHIPEACLKAFKPYQGNPTFDPEFIRSKSTAAAGLCSWCINIVRFYEVYCDVAPKRQALEEANAELAEAQEKLSRIKNKIAELNANLSNLTSAFEKATAEKIKCQQEADATNRVILLANRLVGGLASENIRWAESVENFRSQGVTLCGDVLLISAFVSYVGYFTKKYRNELMEKFWIPYIHNLKVPIPITNGLDPLSLLTDDADVATWNNQGLPSDRMSTENATILGNTERWPLIVDAQLQGIKWIKNKYRSELKAIRLGQKSYLDVIEQAISEGDTLLIENIGETVDPVLDPLLGRNTIKKGKYIKIGDKEVEYHPKFRLILHTKYFNPHYKPEMQAQCTLINFLVTRDGLEDQLLAAVVAKERPDLEQLKANLTKSQNEFKIVLKELEDSLLARLSAASGNFLGDTALVENLETTKHTASEIEEKVVEAKITEVKINEARENYRPAAERASLLYFILNDLNKINPVYQFSLKAFNVVFEKAIQRTTPANEVKQRVINLTDEITYSVYMYTARGLFERDKLIFLAQVTFQVLSMKKELNPVELDFLLRFPFKAGVVSPVDFLQHQGWGGIKALSEMDEFKNLDSDIEGSAKRWKKLVESEAPEKEIFPKEWKNKTALQKLCMVRCLRPDRMTYAIKNFVEEKMGSKFVEGRSVEFSKSYEESSPSTSIFFILSPGVDPLKDVEALGKKLGFTIDNGKLHNVSLGQGQEVVAENALDVAAEKGHWVILQNIHLVARWLGTLDKKLEHYSTGSHEDYRVFISAEPAPSPETHIIPQGILENAIKITNEPPTGMHANLHKALDLFTQDTLEMCTKEMEFKCMLFALCYFHAVVAERRKFGAQGWNRSYPFNNGDLTISINVLYNYLEANPKVPWDDLRYLFGEIMYGGHITDDWDRRLCRTYLAEYIRTEMLEGDVLLAPGFQIPPNLDYKGYHEYIDENLPPESPYLYGLHPNAEIGFLTVTSEKLFRTVLEMQPKETDSGAGTGVSREEKVKAVLDDILEKIPETFNMAEIMAKAAEKTPYVVVAFQECERMNILTNEMRRSLKELNLGLKGELTITTDVEDLSTALFYDTVPDTWVARAYPSMMGLAAWYADLLLRIRRLVCPCRNSRPGRQTLPCPPPCGWPASSTPSRSSRPSCSPWPGRTSGPWTRCVCLSR

SEQ ID NO: 26078 - protein, 4427 aa, Homo sapiens
  Payload ID: 5156
  Gene Symbol: DNAH2
  Gene Name: dynein, axonemal, heavy chain 2
  Uniprot ID: Q9P225
  ENSP ID: ENSP00000373825
MSSKAEKKQRLSGRGSSQASWSGRATRAAVATQEQGNAPAVSEPELQAELPKEEPEPRLEGPQAQSEESVEPEADVKPLFLSRAALTGLADAVWTQEHDAILEHFAQDPTESILTIFIDPCFGLKLELGMPVQTQNQLVYFIRQAPVPITWENFEATVQFGTVRGPYIPALLRLLGGVFAPQIFANTGWPESIRNHFASHLHKFLACLTDTRYKLEGHTVLYIPAEAMNMKPEMVIKDKELVQRLETSMIHWTRQIKEMLSAQETVETGENLGPLEEIEFWRNRCMDLSGISKQLVKKGVKHVESILHLAKSSYLAPFMKLAQQIQDGSRQAQSNLTFLSILKEPYQELAFMKPKDISSKLPKLISLIRIIWVNSPHYNTRERLTSLFRKVCDCQYHFARWEDGKQGPLPCFFGAQGPQITRNLLEIEDIFHKNLHTLRAVRGGILDVKNTCWHEDYNKFRAGIKDLEVMTQNLITSAFELVRDVPHGVLLLDTFHRLASREAIKRTYDKKAVDLYMLFNSELALVNRERNKKWPDLEPYVAQYSGKARWVHILRRRIDRVMTCLAGAHFLPRIGTGKESVHTYQQMVQAIDELVRKTFQEWTSSLDKDCIRRLDTPLLRISQEKAGMLDVNFDKSLLILFAEIDYWERLLFETPHYVVNVAERAEDLRILRENLLLVARDYNRIIAMLSPDEQALFKERIRLLDKKIHPGLKKLHWALKGASAFFITECRIHASKVQMIVNEFKASTLTIGWRAQEMSEKLLVRISGKRVYRDLEFEEDQREHRAAVQQKLMNLHQDVVTIMTNSYEVFKNDGPEIQQQWMLYMIRLDRMMEDALRLNVKWSLLELSKAINGDGKTSPNPLFQVLVILKNDLQGSVAQVEFSPTLQTLAGVVNDIGNHLFSTISVFCHLPDILTKRKLHREPIQTVVEQDEDIKKIQTQISSGMTNNASLLQNYLKTWDMYREIWEINKDSFIHRYQRLNPPVSSFVADIARYTEVANNVQKEETVTNIQFVLLDCSHLKFSLVQHCNEWQNKFATLLREMAAGRLLELHTYLKENAEKISRPPQTLEELGVSLQLVDALKHDLANVETQIPPIHEQFAILEKYEVPVEDSVLEMLDSLNGEWVVFQQTLLDSKQMLKKHKEKFKTGLIHSADDFKKKAHTLLEDFEFKGHFTSNVGYMSALDQITQVRAMLMAMREEENSLRANLGIFKIEQPPSKDLQNLEKELDALQQIWEIARDWEENWNEWKTGRFLILQTETMETTAHGLFRRLTKLAKEYKDRNWEIIETTRSKIEQFKRTMPLISDLRNPALRERHWDQVRDEIQREFDQESESFTLEQIVELGMDQHVEKIGEISASATKELAIEVALQNIAKTWDVTQLDIVPYKDKGHHRLRGTEEVFQALEDNQVALSTMKASRFVKAFEKDVDHWERCLSLILEVIEMILTVQRQWMYLENIFLGEDIRKQLPNESTLFDQVNSNWKAIMDRMNKDNNALRSTHHPGLLDTLIEMNTILEDIQKSLDMYLETKRHIFPRFYFLSNDDLLEILGQSRNPEAVQPHLKKCFDNIKLLRIQKVGGPSSKWEAVGMFSGDGEYIDFLHSVFLEGPVESWLGDVEQTMRVTLRDLLRNCHLALRKFLNKRDKWVKEWAGQVVITASQIQWTADVTKCLLTAKERADKKILKVMKKNQVSILNKYSEAIRGNLTKIMRLKIVALVTIEIHARDVLEKLYKSGLMDVNSFDWLSQLRFYWEKDLDDCVIRQTNTQFQYNYEYLGNSGRLVITPLTDRCYMTLTTALHLHRGGSPKGPAGTGKTETVKDLGKALGIYVIVVNCSEGLDYKSMGRMYSGLAQTGAWGCFDEFNRINIEVLSVVAHQILCILSALAAGLTHFHFDGFEINLVWSCGIFITMNPGYAGRTELPENLKSMFRPIAMVVPDSTLIAEIILFGEGFGNCKILAKKVYTLYSLAVQQLSRQDHYDFGLRALTSLLRYAGKKRRLQPDLTDEEVLLLSMRDMNIAKLTSVDAPLFNAIVQDLFPNIELPVIDYGKLRETVEQEIRDMGLQSTPFTLTKVFQLYETKNSRHSTMIVGCTGSGKTASWRILQASLSSLCRAGDPNFNIVREFPLNPKALSLGELYGEYDLSTNEWTDGILSSVMRTACADEKPDEKWILFDGPVDTLWIENMNSVMDDNKVLTLINGERIAMPEQVSLLFEVEDLAMASPATVSRCGMVYTDYADLGWKPYVQSWLEKRPKAEVEPLQRMFEKLINKMLAFKKDNCKELVPLPEYSGITSLCKLYSALATPENGVNPADGENYVTMVEMTFVFSMIWSVCASVDEEGRKRIDSYLREIEGSFPNKDTVYEYFVDPKIRSWTSFEDKLPKSWRYPPNAPFYKIMVPTVDTVRYNYLVSSLVANQNPILLVGPVGTGKTSIAQSVLQSLPSSQWSVLVVNMSAQTTSNNVQSIIESRVEKRTKGVYVPFGGKSMITFMDDLNMPAKDMFGSQPPLELIRLWIDYGFWYDRTKQTIKYIREMFLMAAMGPPGGGRTVISPRLRSRFNIINMTFPTKSQIIRIFGTMINQKLQDFEEEVKPIGNVVTEATLDMYNTVVQRFLPTPTKMHYLFNLRDISKVFQGMLRANKDFHDTKSSITRLWIHECFRVFSDRLVDAADTEAFMGIISDKLGSFFDLTFHHLCPSKRPPIFGDFLKEPKVYEDLTDLTVLKTVMETALNEYNLSPSVVPMQLVLFREAIEHITRIVRVIGQPRGNMLLVGIGGSGRQSLARLASSICDYTTFQIEVTKHYRKQEFRDDIKRLYRQAGVELKTTSFIFVDTQIADESFLEDINNILSSGEVPNLYKPDEFEEIQSHIIDQARVEQVPESSDSLFAYLIERVQNNLHIVLCLSPMGDPFRNWIRQYPALVNCTTINWFSEWPQEALLEVAEKCLIGVDLGTQENIHRKVAQIFVTMHWSVAQYSQKMLLELRRHNYVTPTKYLELLSGYKKLLGEKRQELLAQANKLRTGLFKIDETREKVQVMSLELEDAKKKVAEFQKQCEEYLVIIVQQKREADEQQKAVTANSEKIAVEEIKCQALADNAQKDLEEALPALEEAMRALESLNKKDIGEIKSYGRPPAQVEIVMQAVMILRGNEPTWAEAKRQLGEQNFIKSLINFDKDNISDKVLKKIGAYCAQPDFQPDIIGRVSLAAKSLCMWVRAMELYGRLYRVVEPKRIRMNAALAQLREKQAALAEAQEKLREVAEKLEMLKKQYDEKLAQKEELRKKSEEMELKLERAGMLVSGLAGEKARWEETVQGLEEDLGYLVGDCLLAAAFLSYMGPFLTNYRDEIVNQIWIGKIWELQVPCSPSFAIDNFLCNPTKVRDWNIQGLPSDAFSTENGIIVTRGNRWALMIDPQAQALKWIKNMEGGQGLKIIDLQMSDYLRILEHAIHFGYPVLLQNVQEYLDPTLNPMLNKSVARIGGRLLMRIGDKEVEYNTNFRFYITTKLSNPHYSPETSAKTTIVNFAVKEQGLEAQLLGIVVRKERPELEEQKDSLVINIAAGKRKLKELEDEILRLLNEATGSLLDDVQLVNTLHTSKITATEVTEQLETSETTEINTDLAREAYRPCAQRASILFFVLNDMGCIDPMYQFSLDAYISLFILSIDKSHRSNKLEDRIDYLNDYHTYAVYRYTCRTLFERHKLLFSFHMCAKILETSGKLNMDEYNFFLRGGVVLDREGQMDNPCSSWLADAYWDNITELDKLTNFHGLMNSFEQYPRDWHLWYTNAAPEKAMLPGEWENACNEMQRMLIVRSLRQDRVAFCVTSFIITNLGSRFIEPPVLNMKSVLEDSTPRSPLVFILSPGVDPTSALLQLAEHMGMAQRFHALSLGQGQAPIAARLLREGVTQGHWVFLANCHLSLSWMPNLDKLVEQLQVEDPHPSFRLWLSSIPHPDFPISILQVSIKMTTEPPKGLKANMTRLYQLMSEPQFSRCSKPAKYKKLLFSLCFFHSVLLERKKFLQLGWNIIYGFNDSDFEVSENLLSLYLDEYEETPWDALKYLIAGINYGGHVTDDWDRRLLTTYINDYFCDQSLSTPFHRLSALETYFIPKDGSLASYKEYISLLPGMDPPEAFGQHPNADVASQITEAQTLFDTLLSLQPQITPTRAGGQTREEKVLELAADVKQKIPEMIDYEGTQKLLALDPSPLNVVLLQEIQRYNTLMQTILFSLTDLEKGIQGLIVMSTSLEEIFNCIFDAHVPPLWGKAYPSQKPLAAWTRDLAMRVEQFELWASRARPPVIFWLSGFTFPTGFLTAVLQSSARQNNVSVDSLSWEFIVSTVDDSNLVYPPKDGVWVRGLYLEGAGWDRKNSCLVEAEPMQLVCLMPTIHFRPAESRKKSAKGMYSCPCYYYPNRAGSSDRASFVIGIDLRSGAMTPDHWIKRGTALLMSLDS

SEQ ID NO: 26079 - protein, 4427 aa, Homo sapiens; identical to SEQ ID NO: 26078
  Payload ID: 5156
  Gene Symbol: DNAH2
  Gene Name: dynein, axonemal, heavy chain 2
  Uniprot ID: Q9P225
  ENSP ID: ENSP00000458355

SEQ ID NO: 26080 - protein, 872 aa, Homo sapiens
  Payload ID: 5156
  Gene Symbol: DNAH2
  Gene Name: dynein, axonemal, heavy chain 2
  Uniprot ID: Q9P225
  ENSP ID: ENSP00000460245
MSSKAEKKQRLSGRGSSQASWSGRATRAAVATQEQGNAPAVSEPELQAELPKEEPEPRLEGPQAQSEESVEPEADVKPLFLSRAALTGLADAVWTQEHDAILEHFAQDPTESILTIFIDPCFGLKLELGMPVQTQNQLVYFIRQAPVPITWENFEATVQFGTVRGPYIPALLRLLGGVFAPQIFANTGWPESIRNHFASHLHKFLACLTDTRYKLEGHTVLYIPAEAMNMKPEMVIKDKELVQRLETSMIHWTRQIKEMLSAQETVETGENLGPLEEIEFWRNRCMDLSGISKQLVKKGVKHVESILHLAKSSYLAPFMKLAQQIQDGSRQAQSNLTFLSILKEPYQELAFMKPKDISSKLPKLISLIRIIWVNSPHYNTRERLTSLFRKMSNEIIRLCCHAISLDRIFEGYVSSSKEDLQGCILCCHAWKDHYVQAVQMHIQFSSRGWVLDQTSIFAQVDAFVQRCKDLIEVCDCQYHFARWEDGKQGPLPCFFGAQGPQITRNLLEIEDIFHKNLHTLRAVRGGILDVKNTCWHEDYNKFRAGIKDLEVMTQNLITSAFELVRDVPHGVLLLDTFHRLASREAIKRTYDKKAVDLYMLFNSELALVNRERNKKWPDLEPYVAQYSGKARWVHILRRRIDRVMTCLAGAHFLPRIGTGKESVHTYQQMVQAIDELVRKTFQEWTSSLDKDCIRRLDTPLLRISQEKAGMLDVNFDKYRSHLAPFPYTPLLQLSQEFHSHLLTPLFIILSLSHTICLLSSFYFFFSSFIFVSPHLPPCYQHFNFTTYLKTQQNKTMIGQARWLTPVIPALWEAEVGASLEPRSLRTAWATWQNPVSAKNTKISWAWWHKPVVSATWEGEVGGSPEPGRQRLQ

SEQ ID NO: 26081 - protein, 261 aa, Homo sapiens
  Payload ID: 5156
  Gene Symbol: DNAH2
  Gene Name: dynein, axonemal, heavy chain 2
  ENSP ID: ENSP00000461273
  MOD_RES (1)..(1): Any amino acid
XDEDIKKIQTQISSGMTNNASLLQNYLKTWDMYREIWEINKDSFIHRYQRLNPPVSSFVADIARYTEVANNVQKEETVTNIQFVLLDCSHLKFSLVQHCNEWQNKFATLLREMAAGRLLELHTYLKENAEKISRPPQTLEELGVSLQLVDALKHDLANVETQIPPIHEQFAILEKYEVPVEDSVLEMLDSLNGEWVVFQQTLLDSKQMLKKHKEKFKTGLIHSADDFKKKAHTLLEDFEFKGARCPPANLGDRTRLGGELE

SEQ ID NO: 26082 - protein, 1158 aa, Homo sapiens
  Payload ID: 5156
  Gene Symbol: DNAH2
  Gene Name: dynein, axonemal, heavy chain 2
  ENSP ID: ENSP00000461726
KIDETREKVQVMSLELEDAKKKVAEFQKQCEEYLVIIVQQKREADEQQKALESLNKKDIGEIKSYGRPPAQVEIVMQAVMILRGNEPTWAEAKRQLGEQNFIKSLINFDKDNISDKVLKKIGAYCAQPDFQPDIIGRVSLAAKSLCMWVRAMELYGRLYRVVEPKRIRMNAALAQLREKQAALAEAQEKLREVAEKLEMLKKQYDEKLAQKEELRKKSEEMELKLERAGMLVSGLAGEKARWEETVQGLEEDLGYLVGDCLLAAAFLSYMGPFLTNYRDEIVNQIWIGKIWELQVPCSPSFAIDNFLCNPTKVRDWNIQGLPSDAFSTENGIIVTRGNRWALMIDPQAQALKWIKNMEGGQGLKIIDLQMSDYLRILEHAIHFGYPVLLQNVQEYLDPTLNPMLNKSVARIGGRLLMRIGDKEVEYNTNFRFYITTKLSNPHYSPETSAKTTIVNFAVKEQGLEAQLLGIVVRKERPELEEQKDSLVINIAAGKRKLKELEDEILRLLNEATGSLLDDVQLVNTLHTSKITATEVTEQLETSETTEINTDLAREAYRPCAQRASILFFVLNDMGCIDPMYQFSLDAYISLFILSIDKSHRSNKLEDRIDYLNDYHTYAVYRYTCRTLFERHKLLFSFHMCAKILETSGKLNMDEYNFFLRGGVVLDREGQMDNPCSSWLADAYWDNITELDKLTNFHGLMNSFEQYPRDWHLWYTNAAPEKAMLPGEWENACNEMQRMLIVRSLRQDRVAFCVTSFIITNLGSRFIEPPVLNMKSVLEDSTPRSPLVFILSPGVDPTSALLQLAEHMGMAQRFHALSLGQGQAPIAARLLREGVTQGHWVFLANCHLSLSWMPNLDKLVEQLQVEDPHPSFRLWLSSIPHPDFPISILQVSIKMTTEPPKGLKANMTRLYQLMSEPQFSRCSKPAKYKKLLFSLCFFHSVLLERKKFLQLGWNIIYGFNDSDFEVSENLLSLYLDEYEETPWDALKYLIAGINYGGHVTDDWDRRLLTTYINDYFCDQSLSTPFHRLSALETYFIPKDGSLASYKEYISLLPGMDPPEAFGQHPNADVASQITEAQTLFDTLLSLQPQITPTRAGGQTREEKVLELAADVKQKIPEMIDYEGTQKLLALDPSPLNVVLLQEIQRYNTLMQTILFSLTD

SEQ ID NO: 26083 - protein, 4116 aa, Homo sapiens
  Payload ID: 5157
  Gene Symbol: DNAH3
  Gene Name: dynein, axonemal, heavy chain 3
  Uniprot ID: Q8TD57
  ENSP ID: ENSP00000261383
MGATGRLELTLAAPPHPGPAFQRSKARETQGEEEGSEMQIAKSDSIHHMSHSQGQPELPPLPASANEEPSGLYQTVMSHSFYPPLMQRTSWTLAAPFKEQHHHRGPSDSIANNYSLMAQDLKLKDLLKVYQPATISVPRDRTGQGLPSSGNRSSSEPMRKKTKFSSRNKEDSTRIKLAFKTSIFSPMKKEVKTSLTFPGSRPMSPEQQLDVMLQQEMEMESKEKKPSESDLERYYYYLTNGIRKDMIAPEEGEVMVRISKLISNTLLTSPFLEPLMVVLVQEKENDYYCSLMKSIVDYILMDPMERKRLFIESIPRLFPQRVIRAPVPWHSVYRSAKKWNEEHLHTVNPMMLRLKELWFAEFRDLRFVRTAEILAGKLPLQPQEFWDVIQKHCLEAHQTLLNKWIPTCAQLFTSRKEHWIHFAPKSNYDSSRNIEEYFASVASFMSLQLRELVIKSLEDLVSLFMIHKDGNDFKEPYQEMKFFIPQLIMIKLEVSEPIIVFNPSFDGCWELIRDSFLEIIKNSNGIPKLKYIPLKFSFTAAAADRQCVKAAEPGEPSMHAAATAMAELKGYNLLLGTVNAEEKLVSDFLIQTFKVFQKNQVGPCKYLNVYKKYVDLLDNTAEQNIAAFLKENHDIDDFVTKINAIKKRRNEIASMNITVPLAMFCLDATALNHDLCERAQNLKDHLIQFQVDVNRDTNTSICNQYSHIADKVSEVPANTKELVSLIEFLKKSSAVTVFKLRRQLRDASERLEFLMDYADLPYQIEDIFDNSRNLLLHKRDQAEMDLIKRCSEFELRLEGYHRELESFRKREVMTTEEMKHNVEKLNELSKNLNRAFAEFELINKEEELLEKEKSTYPLLQAMLKNKVPYEQLWSTAYEFSIKSEEWMNGPLFLLNAEQIAEEIGNMWRTTYKLIKTLSDVPAPRRLAENVKIKIDKFKQYIPILSISCNPGMKDRHWQQISEIVGYEIKPTETTCLSNMLEFGFGKFVEKLEPIGAAASKEYSLEKNLDRMKLDWVNVTFSFVKYRDTDTNILCAIDDIQMLLDDHVIKTQTMCGSPFIKPIEAECRKWEEKLIRIQDNLDAWLKCQATWLYLEPIFSSEDIIAQMPEEGRKFGIVDSYWKSLMSQAVKDNRILVAADQPRMAEKLQEANFLLEDIQKGLNDYLEKKRLFFPRFFFLSNDELLEILSETKDPLRVQPHLKKCFEGIAKLEFTDNLEIVGMISSEKETVPFIQKIYPANAKGMVEKWLQQVEQMMLASMREVIGLGIEAYVKVPRNHWVLQWPGQVVICVSSIFWTQEVSQALAENTLLDFLKKSNDQIAQIVQLVRGKLSSGARLTLGALTVIDVHARDVVAKLSEDRVSDLNDFQWISQLRYYWVAKDVQVQIITTEALYGYEYLGNSPRLVITPLTDRCYRTLMGALKLNLGGAPEGPAGTGKTETTKDLAKALAKQCVVFNCSDGLDYKAMGKFFKGLAQAGAWACFDEFNRIEVEVLSVVAQQILSIQQAIIRKLKTFIFEGTELSLNPTCAVFITMNPGYAGRAELPDNLKALFRTVAMMVPDYALIGEISLYSMGFLDSRSLAQKIVATYRLCSEQLSSQHHYDYGMRAVKSVLTAAGNLKLKYPEENESVLLLRALLDVNLAKFLAQDVPLFQGIISDLFPGVVLPKPDYEVFLKVLNDNIKKMKLQPVPWFIGKIIQIYEMMLVRHGYMIVGDPMGGKTSAYKVLAAALGDLHAANQMEEFAVEYKIINPKAITMGQLYGCFDQVSHEWMDGVLANAFREQASSLSDDRKWIIFDGPVDAIWIENMNTVLDDNKKLCLMSGEIIQMNSKMSLIFEPADLEQASPATVSRCGMIYMEPHQLGWKPLKDSYMDTLPSSLTKEHKELVNDMFMWLVQPCLEFGRLHCKFVVQTSPIHLAFSMMRLYSSLLDEIRAVEEEEMELGEGLSSQQIFLWLQGLFLFSLVWTVAGTINADSRKKFDVFFRNLIMGMDDNHPRPKSVKLTKNNIFPERGSIYDFYFIKQASGHWETWTQYITKEEEKVPAGAKVSELIIPTMETARQSFFLKTYLDHEIPMLFVGPTGTGKSAITNNFLLHLPKNTYLPNCINFSARTSANQTQDIIMSKLDRRRKGLFGPPIGKKAVVFVDDLNMPAKEVYGAQPPIELLRQWIDHGYWFDKKDTTRLDIVDMLLVTAMGPPGGGRNDITGRFTRHLNIISINAFEDDILTKIFSSIVDWHFGKGFDVMFLRYGKMLVQATKTIYRDAVENFLPTPSKSHYVFNLRDFSRVIQGVLLCPHTHLQDVEKCIRLWIHEVYRVFYDRLIDKEDRQVFFNMVKETTSNCFKQTIEKVLIHLSPTGKIVDDNIRSLFFGDYFKPESDQKIYDEITDLKQLTVVMEHYLEEFNNISKAPMSLVMFRFAIEHISRICRVLKQDKGHLLLVGIGGSGRQSAAKLSTFMNAYELYQIEITKNYAGNDWREDLKKIILQVGVATKSTVFLFADNQIKDESFVEDINMLLNTGDVPNIFPADEKADIVEKMQTAARTQGEKVEVTPLSMYNFFIERVINKISFSLAMSPIGDAFRNRLRMFPSLINCCTIDWFQSWPTDALELVANKFLEDVELDDNIRVEVVSMCKYFQESVKKLSLDYYNKLRRHNYVTPTSYLELILTFKTLLNSKRQEVAMMRNRYLTGLQKLDFAASQVAVMQRELTALQPQLILTSEETAKMMVKIEAETREADGKKLLVQADEKEANVAAAIAQGIKNECEGDLAEAMPALEAALAALDTLNPADISLVKSMQNPPGPVKLVMESICIMKGMKPERKPDPSGSGKMIEDYWGVSKKILGDLKFLESLKTYDKDNIPPLTMKRIRERFINHPEFQPAVIKNVSSACEGLCKWVRAMEVYDRVAKVVAPKRERLREAEGKLAAQMQKLNQKRAELKLVVDRLQALNDDFEEMNTKKKDLEENIEICSQKLVRAEKLISGLGGEKDRWTEAARQLGIRYTNLTGDVLLSSGTVAYLGAFTVDYRVQCQNQWLAECKDKVIPGFSDFSLSHTLGDPIKIRAWQIAGLPVDSFSIDNGIIVSNSRRWALMIDPHGQANKWIKNMEKANKLAVIKFSDSNYMRMLENALQLGTPVLIENIGEELDASIEPILLKATFKQQGVEYMRLGENIIEYSRDFKLYITTRLRNPHYLPEVAVKVCLLNFMITPLGLQDQLLGIVAAKEKPELEEKKNQLIVESAKNKKHLKEIEDKILEVLSMSKGNILEDETAIKVLSSSKVLSEEISEKQKVASMTETQIDETRMGYKPVAVHSATIFFCISDLANIEPMYQYSLTWFINLYMHSLTHSTKSEELNLRIKYIIDHFTLSIYNNVCRSLFEKDKLLFSLLLTIGIMKQKKEITEEVWYFLLTGGIALDNPYPNPAPQWLSEKAWAEIVRASALPKLHGLMEHLEQNLGEWKLIYDSAWPHEEQLPGSWKFSQGLEKMVILRCLRPDKMVPAVREFIAEHMGKLYIEAPTFDLQGSYNDSSCCAPLIFVLSPSADPMAGLLKFADDLGMGGTRTQTISLGQGQGPIAAKMINNAIKDGTWVVLQNCHLAASWMPTLEKICEEVIVPESTNARFRLWLTSYPSEKFPVSILQNGIKMTNEPPKGLRANLLRSYLNDPISDPVFFQSCAKAVMWQKMLFGLCFFHAVVQERRNFGPLGWNIPYEFNESDLRISMWQIQMFLNDYKEVPFDALTYLTGECNYGGRVTDDKDRRLLLSLLSMFYCKEIEEDYYSLAPGDTYYIPPHGSYQSYIDYLRNLPITAHPEVFGLHENADITKDNQETNQLFEGVLLTLPRQSGGSGKSPQEVVEELAQDILSKLPRDFDLEEVMKLYPVVYEESMNTVLRQELIRFNRLTKVVRRSLINLGRAIKGQVLMSSELEEVFNSMLVGKVPAMWAAKSYPSLKPLGGYVADLLARLTFFQEWIDKGPPVVFWISGFYFTQSFLTGVSQNYARKYTIPIDHIGFEFEVTPQETVMENNPEDGAYIKGLFLEGARWDRKTMQIGESLPKILYDPLPIIWLKPGESAMFLHQDIYVCPVYKTSARRGTLSTTGHSTNYVLSIELPTDMPQKHWINRGVASLCQLDN

SEQ ID NO: 26084 - protein, 4624 aa, Homo sapiens
  Payload ID: 5158
  Gene Symbol: DNAH5
  Gene Name: dynein, axonemal, heavy chain 5
  Uniprot ID: Q8TE73
  ENSP ID: ENSP00000265104
MFRIGRRQLWKHSVTRVLTQRLKGEKEAKRALLDARHNYLFAIVASCLDLNKTEVEDAILEGNQIERIDQLFAVGGLRHLMFYYQDVEEAETGQLGSLGGVNLVSGKIKKPKVFVTEGNDVALTGVCVFFIRTDPSKAITPDNIHQEVSFNMLDAADGGLLNSVRRLLSDIFIPALRATSHGWGELEGLQDAANIRQEFLSSLEGFVNVLSGAQESLKEKVNLRKCDILELKTLKEPTDYLTLANNPETLGKIEDCMKVWIKQTEQVLAENNQLLKEADDVGPRAELEHWKKRLSKFNYLLEQLKSPDVKAVLAVLAAAKSKLLKTWREMDIRITDATNEAKDNVKYLYTLEKCCDPLYSSDPLSMMDAIPTLINAIKMIYSISHYYNTSEKITSLFVKVTNQIISACKAYITNNGTASIWNQPQDVVEEKILSAIKLKQEYQLCFHKTKQKLKQNPNAKQFDFSEMYIFGKFETFHRRLAKIIDIFTTLKTYSVLQDSTIEGLEDMATKYQGIVATIKKKEYNFLDQRKMDFDQDYEEFCKQTNDLHNELRKFMDVTFAKIQNTNQALRMLKKFERLNIPNLGIDDKYQLILENYGADIDMISKLYTKQKYDPPLARNQPPIAGKILWARQLFHRIQQPMQLFQQHPAVLSTAEAKPIIRSYNRMAKVLLEFEVLFHRAWLRQIEEIHVGLEASLLVKAPGTGELFVNFDPQILILFRETECMAQMGLEVSPLATSLFQKRDRYKRNFSNMKMMLAEYQRVKSKIPAAIEQLIVPHLAKVDEALQPGLAALTWTSLNIEAYLENTFAKIKDLELLLDRVNDLIEFRIDAILEEMSSTPLCQLPQEEPLTCEEFLQMTKDLCVNGAQILHFKSSLVEEAVNELVNMLLDVEVLSEEESEKISNENSVNYKNESSAKREEGNFDTLTSSINARANALLLTTVTRKKKETEMLGEEARELLSHFNHQNMDALLKVTRNTLEAIRKRIHSSHTINFRDSNSASNMKQNSLPIFRASVTLAIPNIVMAPALEDVQQTLNKAVECIISVPKGVRQWSSELLSKKKIQERKMAALQSNEDSDSDVEMGENELQDTLEIASVNLPIPVQTKNYYKNVSENKEIVKLVSVLSTIINSTKKEVITSMDCFKRYNHIWQKGKEEAIKTFITQSPLLSEFESQILYFQNLEQEINAEPEYVCVGSIALYTADLKFALTAETKAWMVVIGRHCNKKYRSEMENIFMLIEEFNKKLNRPIKDLDDIRIAMAALKEIREEQISIDFQVGPIEESYALLNRYGLLIAREEIDKVDTLHYAWEKLLARAGEVQNKLVSLQPSFKKELISAVEVFLQDCHQFYLDYDLNGPMASGLKPQEASDRLIMFQNQFDNIYRKYITYTGGEELFGLPATQYPQLLEIKKQLNLLQKIYTLYNSVIETVNSYYDILWSEVNIEKINNELLEFQNRCRKLPRALKDWQAFLDLKKIIDDFSECCPLLEYMASKAMMERHWERITTLTGHSLDVGNESFKLRNIMEAPLLKYKEEIEDICISAVKERDIEQKLKQVINEWDNKTFTFGSFKTRGELLLRGDSTSEIIANMEDSLMLLGSLLSNRYNMPFKAQIQKWVQYLSNSTDIIESWMTVQNLWIYLEAVFVGGDIAKQLPKEAKRFSNIDKSWVKIMTRAHEVPSVVQCCVGDETLGQLLPHLLDQLEICQKSLTGYLEKKRLCFPRFFFVSDPALLEILGQASDSHTIQAHLLNVFDNIKSVKFHEKIYDRILSISSQEGETIELDKPVMAEGNVEVWLNSLLEESQSSLHLVIRQAAANIQETGFQLTEFLSSFPAQVGLLGIQMIWTRDSEEALRNAKFDKKIMQKTNQAFLELLNTLIDVTTRDLSSTERVKYETLITIHVHQRDIFDDLCHMHIKSPMDFEWLKQCRFYFNEDSDKMMIHITDVAFIYQNEFLGCTDRLVITPLTDRCYITLAQALGMSMGGAPAGPAGTGKTETTKDMGRCLGKYVVVFNCSDQMDFRGLGRIFKGLAQSGSWGCFDEFNRIDLPVLSVAAQQISIILTCKKEHKKSFIFTDGDNVTMNPEFGLFLTMNPGYAGRQELPENLKINFRSVAMMVPDRQIIIRVKLASCGFIDNVVLARKFFTLYKLCEEQLSKQVHYDFGLRNILSVLRTLGAAKRANPMDTESTIVMRVLRDMNLSKLIDEDEPLFLSLIEDLFPNILLDKAGYPELEAAISRQVEEAGLINHPPWKLKVIQLFETQRVRHGMMTLGPSGAGKTTCIHTLMRAMTDCGKPHREMRMNPKAITAPQMFGRLDVATNDWTDGIFSTLWRKTLRAKKGEHIWIILDGPVDAIWIENLNSVLDDNKTLTLANGDRIPMAPNCKIIFEPHNIDNASPATVSRNGMVFMSSSILDWSPILEGFLKKRSPQEAEILRQLYTESFPDLYRFCIQNLEYKMEVLEAFVITQSINMLQGLIPLKEQGGEVSQAHLGRLFVFALLWSAGAALELDGRRRLELWLRSRPTGTLELPPPAGPGDTAFDYYVAPDGTWTHWNTRTQEYLYPSDTTPEYGSILVPNVDNVRTDFLIQTIAKQGKAVLLIGEQGTAKTVIIKGFMSKYDPECHMIKSLNFSSATTPLMFQRTIESYVDKRMGTTYGPPAGKKMTVFIDDVNMPIINEWGDQVTNEIVRQLMEQNGFYNLEKPGEFTSIVDIQFLAAMIHPGGGRNDIPQRLKRQFSIFNCTLPSEASVDKIFGVIGVGHYCTQRGFSEEVRDSVTKLVPLTRRLWQMTKIKMLPTPAKFHYVFNLRDLSRVWQGMLNTTSEVIKEPNDLLKLWKHECKRVIADRFTVSSDVTWFDKALVSLVEEEFGEEKKLLVDCGIDTYFVDFLRDAPEAAGETSEEADAETPKIYEPIESFSHLKERLNMFLQLYNESIRGAGMDMVFFADAMVHLVKISRVIRTPQGNALLVGVGGSGKQSLTRLASFIAGYVSFQITLTRSYNTSNLMEDLKVLYRTAGQQGKGITFIFTDNEIKDESFLEYMNNVLSSGEVSNLFARDEIDEINSDLASVMKKEFPRCLPTNENLHDYFMSRVRQNLHIVLCFSPVGEKFRNRALKFPALISGCTIDWFSRWPKDALVAVSEHFLTSYDIDCSLEIKKEVVQCMGSFQDGVAEKCVDYFQRFRRSTHVTPKSYLSFIQGYKFIYGEKHVEVRTLANRMNTGLEKLKEASESVAALSKELEAKEKELQVANDKADMVLKEVTMKAQAAEKVKAEVQKVKDRAQAIVDSISKDKAIAEEKLEAAKPALEEAEAALQTIRPSDIATVRTLGRPPHLIMRIMDCVLLLFQRKVSAVKIDLEKSCTMPSWQESLKLMTAGNFLQNLQQFPKDTINEEVIEFLSPYFEMPDYNIETAKRVCGNVAGLCSWTKAMASFFSINKEVLPLKANLVVQENRHLLAMQDLQKAQAELDDKQAELDVVQAEYEQAMTEKQTLLEDAERCRHKMQTASTLISGLAGEKERWTEQSQEFAAQTKRLVGDVLLATAFLSYSGPFNQEFRDLLLNDWRKEMKARKIPFGKNLNLSEMLIDAPTISEWNLQGLPNDDLSIQNGIIVTKASRYPLLIDPQTQGKIWIKNKESRNELQITSLNHKYFRNHLEDSLSLGRPLLIEDVGEELDPALDNVLERNFIKTGSTFKVKVGDKEVDVLDGFRLYITTKLPNPAYTPEISARTSIIDFTVTMKGLEDQLLGRVILTEKQELEKERTHLMEDVTANKRRMKELEDNLLYRLTSTQGSLVEDESLIVVLSNTKRTAEEVTQKLEISAETEVQINSAREEYRPVATRGSILYFLITEMRLVNEMYQTSLRQFLGLFDLSLARSVKSPITSKRIANIIEHMTYEVYKYAARGLYEEHKFLFTLLLTLKIDIQRNRVKHEEFLTLIKGGASLDLKACPPKPSKWILDITWLNLVELSKLRQFSDVLDQISRNEKMWKIWFDKENPEEEPLPNAYDKSLDCFRRLLLIRSWCPDRTIAQARKYIVDSMGEKYAEGVILDLEKTWEESDPRTPLICLLSMGSDPTDSIIALGKRLKIETRYVSMGQGQEVHARKLLQQTMANGGWALLQNCHLGLDFMDELMDIIIETELVHDAFRLWMTTEAHKQFPITLLQMSIKFANDPPQGLRAGLKRTYSGVSQDLLDVSSGSQWKPMLYAVAFLHSTVQERRKFGALGWNIPYEFNQADFNATVQFIQNHLDDMDVKKGVSWTTIRYMIGEIQYGGRVTDDYDKRLLNTFAKVWFSENMFGPDFSFYQGYNIPKCSTVDNYLQYIQSLPAYDSPEVFGLHPNADITYQSKLAKDVLDTILGIQPKDTSGGGDETREAVVARLADDMLEKLPPDYVPFEVKERLQKMGPFQPMNIFLRQEIDRMQRVLSLVRSTLTELKLAIDGTIIMSENLRDALDCMFDARIPAWWKKASWISSTLGFWFTELIERNSQFTSWVFNGRPHCFWMTGFFNPQGFLTAMRQEITRANKGWALDNMVLCNEVTKWMKDDISAPPTEGVYVYGLYLEGAGWDKRNMKLIESKPKVLFELMPVIRIYAENNTLRDPRFYSCPIYKKPVRTDLNYIAAVDLRTAQTPEHWVLRGVALLCDVK

SEQ ID NO: 26085 - protein, 4158 aa, Homo sapiens
  Payload ID: 5159
  Gene Symbol: DNAH6
  Gene Name: dynein, axonemal, heavy chain 6
  Uniprot ID: Q9C0G6
  ENSP ID: ENSP00000237449
MTFRATDSEFDLTNIEEYAENSALSRLNNIKAKQRVSYVTSTENESDTQILTFRHITKAQEKTRKRQQPIKLEPLPVLKVYQDHKQPEYIHEQNRFQLMTAGIIKRPVSIAKKSFATSSTQFLEHQDAVKKMQIHRPYVEVFSPSPPKLPHTGIGKRGLFGTRSSAYPKYTFHDREEVVKANIRDPLQIIKIIRENEHLGFLYMIPAVPRSSIEYDTYNLKVVSYENINKNDYYTISQRAVTHIYNEDIEFIEIDRWEQEYLYHRELTKIPIFSLFRKWKAFSVWRKNVRSKKITGCQKSLQKNLFIVNPHLRPALLKINELCYHLSFMGLCYIEKCHTYTLQEFKAAQVIRLAEVTERLGEFRNEAKYVVRRACRFALRAAGFVPDDCAFGPFEDYHKVQSSGSFINTPHELPTYGDSEKMTYTEQASKRHYCMRLTCFIRLNDYLIENTMHILTVNAVNSLLNHLTDKLKRTPSADVIQKWITEEKPEVPDKKGTLMVEKQEEDESLIPMFLTELMLTVQSLLFEPSLEDFLDGILGAVNHCQNTVLSVPNLVPDSYFDAFTSPYINNKLEGKTCGTGPSLAAVFEDDKNFHTIISQIKETIQAAFESARIYAATFEKFQIFFKENESLDLQALKLQEPDINFFSEQLEKYHKQHKDAVALRPTRNVGLLLIDTRLLREKLIPSPLRCLEVLNFMLPRQSKKKVDAIIFEAQDAEYKLEFVPTTTTEYVHSLLFLDEIQERIESLEDEGNIVTQMYKLMEQYQVPTPPEDFAVFATMKPSIVAVRNAIDKSVGDRESSIKQFCVHLGSDLEELNNEVNEVKLQAQDPQILDISADQDKIRLILNNLQSVLADLQKRAFQYKSYQKNFKVEVSKFEALEEVSAELKLKQLLWDSFSEWDKLQQEWLKSKFDCLDPEVLNGQVSKYAKFVTQLEKGLPPNSVVPQLKYKVEKMKEKLPVIIDLRNPTLKARHWAAIEQTVDATLVDAEIPLTLERLSQLHVFDFGQEIQDISGQASGEAALEAILKKVEDSWKTTEFVILPHRDSKDVFILGGTDDIQVLLDDSTINVATLASSRYLGPLKTRVDEWQKQLALFNQTLEEWLTCQRNWLYLESIFNAPDIQRQLPAEAKMFLQVDKSWKEIMRKVNRLPNALRAATQPGLLETFQNNNALLDQIQKCLEAYLESKRVIFPRFYFLSNDELLEILAQTRNPQAVQPHLRKCFDSISKLEFALMPPAEGKIPGIDGEPEKVYTNDILAMLSPEGERVSLGKGLKARGNVEEWLGKVEEAMFTSLRRLCKAAIADYQGKLRTDWVVAGHPSQVILTVSQIMWCRDLTECLETEHSNHIQALKNFEKVNFERLNALAAIVQGSLPKLHRNILTALITIDVHARDIVTELVQSKVETVESFDWQRQLRYYWDIDLDNCVARMALSQYTYGYEYLGACPRLVITPLTDRCYLCLMGALQLDLGGAPAGPAGTGKTETTKDLAKALAIQCVVFNCSDGLDYKMMGRFFSGLAQSGAWCCFDEFNRIDIEVLSVIAQQLITIRNAKAAKLSRFMFEGREIKLVMTCAAFITMNPGYAGRTELPDNLKALFRPFAMMVPNYALIAEVILYSEGFESSKILARKMTQMYKLCSEQLSQQDHYDFGMRAVKSVLVMAGSLKRENPDLNEDVVLIRALQDSNLPKFLTDDALLFSGIISDLFPGVQIPEHDYGILQSTIVDVMNRQNLQPEMCMVRKVIQFYETMLVRHGVMLVGPTGGGKTTVYRILAETLGNLQKLGIENSFYQAVKTYVLNPKSITMGELYGEVNNLTLEWKDGLMALSVRAAVNDTSEDHKWIISDGPVDALWIENMNTVLDDNKMLCLANSERIKLTPQIHMLFEVQDLRVASPATVSRCGMVFVDPEELKWMPYVKTWMKGISKKLTEETQEYILNLFQRYVDEGLHFINKKCSQAIPQVDISKVTTLCCLLESLILGKDGVNLAMEQTKLNTILCQTFVFCYLWSLGGNLTENYYDSFDTFIRTQFDDNPDARLPNSGDLWSIHMDFDTKRLDPWERIIPTFKYNRDVPFFEMLVPTTDTVRYGYLMEKLLAVKHSVLFTGITGVGKSVIAKGLLNKIQESAGYVPVYLNFSAQTSSARTQEIIESKLERKRKNILGAPGNKRIVIFVDDLNMPRLDRYGSQPPIELLRQYQDFGGFYDRNKLFWKEIQDVTIISACAPPGGGRNPVTPRFIRHFSMLCLPMPSEHSLKQIFQAILNGFLSDFPPAVKQTASSIVEASVEIYNKMSVDLLPTPAKSHYVFNLRDLSKCVQGILQCDPGTIREEIQIFRLFCHECQRVFHDRLINNEDKHYFHVILTEMANKHFGIAIDLEYFLNKPIIFGDFIKFGADKADRIYDDMPDIEKTANVLQDYLDDYNLTNPKEVKLVFFQDAIEHVSRIARMIRQERGNALLVGVGGTGKQSLTRLAAHICGYKCLQIELSRGYNYDSFHEDLRKLYKMAGVEDKNMVFLFTDTQIVVEEFLEDINNILNSGEVPNLFEKDELEQVLAATRPRAKEVGISEGNRDEVFQYFISKVRQKLHIVLCMSPVGEAFRSRCRMFPSLVNCCTIDWFVQWPREALLSVSKTFFSQVDAGNEELKEKLPLMCVNVHLSVSSMAERYYNELRRRYYTTPTSYLELINLYLSMLSEKRKQIISARDRVKNGLTKLLETNILVDKMKLDLSALEPVLLAKSEDVEALMEKLAVDQESADQVRNTVQEDEATAKVKAEETQAIADDAQRDLDEALPALDAANKALDSLDKADISEIRVFTKPPDLVMTVMEAISILLNAKPDWPSAKQLLGDSNFLKRLLEYDKENIKPQILAKLQKYINNPDFVPEKVEKVSKACKSMCMWVRAMDLYSRVVKVVEPKRQKLRAAQAELDITMATLREKQALLRQVEDQIQALQDEYDKGVNEKESLAKTMALTKARLVRAGKLTAALEDEQVRWEESIQKFEEEISNITGNVFIAAACVAYYGAFTAQYRQSLIECWIQDCQSLEIPIDPSFSLINILGDPYEIRQWNTDGLPRDLISTENGILVTQGRRWPLMIDPQDQANRWIRNKESKSGLKIIKLTDSNFLRILENSIRLGLPVLLEELKETLDPALEPILLKQIFISGGRLLIRLGDSDIDYDKNFRFYMTTKMPNPHYLPEVCIKVTIINFTVTKSGLEDQLLSDVVRLEKPRLEEQRIKLIVRINTDKNQLKTIEEKILRMLFTSEGNILDNEELIDTLQDSKITSGAIKTRLEEAESTEQMINVAREKYRPVATQGSVMYFVIASLSEIDPMYQYSLKYFKQLFNTTIETSVKTENLQQRLDVLLEQTLLTAYVNVSRGLFEQHKLIYSFMLCVEMMRQQGTLSDAEWNFFLRGSAGLEKERPPKPEAPWLPTATWFACCDLEESFPVFHGLTQNILSHPISIRLGSFETYINPQKWEGYSKMKHEDKHMRQEKEAAHQDPWSAGLSSFHKLILIKCCKEEKVVFALTDFVIENLGKQFIETPPVDLPTLYQDMSCNTPLVFILSTGSDPMGAFQRFARESGYSERVQSISLGQGQGPIAEKMVKDAMKSGNWVFLQNCHLAVSWMLAMEELIKTFTDPDSAIKDTFRLFLSSMPSNTFPVTVLQNSVKVTNEPPKGLRANIRRAFTEMTPSFFEENILGKKWRQIIFGICFFHAIIQERKKFGPLGWNICYEFNDSDRECALLNLKLYCKEGKIPWDALIYITGEITYGGRVTDSWDQRCLRTILKRFFSPETLEEDYKYSESGIYFAPMADSLQEFKDYIENLPLIDDPEIFGMHENANLVFQYKETSTLINTILEVQPRSSTGGEGKSNDEIVQELVASVQTRVPEKLEMEGASESLFVKDLQGRLNSLTTVLGQEVDRFNNLLKLIHTSLETLNKAIAGFVVMSEEMEKVYNSFLNNQVPALWSNTAYPSLKPLGSWVKDLILRTSFVDLWLKRGQPKSYWISGFFFPQGFLTGTLQNHARKYNLPIDELSFKYSVIPTYRDQAAVIEAAKTVQFGQELPMDMELPSPEDGVLVHGMFMDASRWDDKEMVIEDALPGQMNPVLPVVHFEPQQNYKPSPTLYHCPLYKTGARAGTLSTTGHSTNFVVTVLLPSKRSKDYWIAKGSALLCQLSE

SEQ ID NO: 26086 - protein, 4158 aa, Homo sapiens; identical to SEQ ID NO: 26085
  Payload ID: 5159
  Gene Symbol: DNAH6
  Gene Name: dynein, axonemal, heavy chain 6
  Uniprot ID: Q9C0G6
  ENSP ID: ENSP00000374045

SEQ ID NO: 26087 - protein, 551 aa, Homo sapiens
  Payload ID: 5159
  Gene Symbol: DNAH6
  Gene Name: dynein, axonemal, heavy chain 6
  ENSP ID: ENSP00000473441
MEQTKLNTILCQTFVFCYLWSLGGNLTENYYDSFDTFIRTQFDDNPDARLPNSGDLWSIHMDFDTKRLDPWERIIPTFKYNRDVPFFEMLVPTTDTVRYGYLMEKLLAVKHSVLFTGITGVGKSVIAKGLLNKIQESAGYVPVYLNFSAQTSSARTQEIIESKLERKRKNILGAPGNKRIVIFVDDLNMPRLDRYGSQPPIELLRQYQDFGGFYDRNKLFWKEIQDVTIISACAPPGGGRNPVTPRFIRHFSMLCLPMPSEHSLKQIFQAILNGFLSDFPPAVKQTASSIVEASVEIYNKMSVDLLPTPAKSHYVFNLRDLSKCVQDKHFGIAIDLEYFLNKPIIFGDFIKFGADKADRIYDDMPDIEKTANVLQDYLDDYNLTNPKEVKLVFFQDAIEHVSRIARMIRQERGNALLVGVGGTGKQSLTRLAAHICGYKCLQIELSRGYNYDSFHEDLRKLYKMAGVEDKNMVFLFTDTQIVVEEFLEDINNILNSGEVPNLFEKDELEQVLAATRPRAKEVGISEGNRDEVGCARVVMWLYHKNVSSPFI

SEQ ID NO: 26088 - protein, 4024 aa, Homo sapiens
  Payload ID: 5160
  Gene Symbol: DNAH7
  Gene Name: dynein, axonemal, heavy chain 7
  Uniprot ID: Q8WXX0
  ENSP ID: ENSP00000311273
MSSEQDKSASKEKSKKPVRFLPQLSMEKLASKEKFKAPARALPQLSMVSTKPHWQQAAPSFHLSVKQDDESPEPFSVKNEQSHAEYMERFGKKGKLPHQVDDSYVGPSTSKSKGKSPHKERENFRSTLVNVIMQQDADLDSAVPDGSTIPKPTASAIEKDILRYYYYIHHGIDTDHVAPMEDSWLEHVLDLVPQHLKVFTDSIVTLSDEMREDYLLSVRKSIVDFVLKDPREKGDDKKTDELPAHRAEMEILPKPWRKSFLAASSYIRDHLNAMNPTMLAVLDLWHTNFKKLRLVDIKEFHNCQDALELSSFQNIIMRHMDSAKETLLKMWFPEVQNIYYQGNKKKQLPTGDSSAKLESFFNCAAALMTLQLQDLTLVSMQDFTDLIAQPPDSVRAFEHPGFIMRLILDNDTIKFEPELSDYIDIFLNVYDVMIKAVSFVPRVETKLYSKWESKSKPTTLKPIILNEIVDAHKEKIKEVIMKESVAPTEHLRLYDKYDFLITRKAERDVDNFLAENHSYEKIIDEICKYQKLIEEIQYTSIKTIRLGMFEMHCEELIRALVKRADIICGKLLAKMFRDHQEVNTRLCDEFERIAEKALSTPPNTAELMEMKAYIQKVEVTDMIELEQRLVDSKNCLAFLIEYVNFSPADMRLNNSVFQWYGRMGEIFEEHRKIIKEKIEQYQEGLKLRCERFVEELESYAKQSEEFYSFGDLQDVQRYLKKAQILNGKLDLAADKIEQFNAEEEAFGWLPSVYPQRKKIQDGLNPYLRLYETAVEFSSNYRAWTEGPYHKVNPDQVEADIGNYWRGLYKLEKTFHDSPYALAMTKKVRSKVEDFKQHIPLIQVICNPGLRPRHWEAMSAIVGYPLQPSDDSTVSSFLDMNLEPYIDRFEGISEAASKEYSLEKAMEKMITEWDAVEFVIHSYRETGTFILASVDEIQMLLDDHIIKTQTMRGSPFIKPYEKQMREWEGKLLLLQEILDEWLKVQATWLYLEPIFSSPDIMSQMPEEGRRFTAVDKTWRDIMRSVMQDKHVLTVVTIDRMLERLKKSNELLELILKGLNEYLEKKRLFFPRFFFLSNDELLEILSETKDPTRVQPHLKKCFEGIAKVEFTETLDITHMKSSEGEVVELIEIISTAKARGQVEKWLVELERVMINSIHKVTGDATFAYTKYERINWVRDWPGQTVLCVSQIFWTKEVQTAIPMGIKALEQYLKTCNRQIDDIVTLVRGKLSMQNRVTLGALVVLDVHARDVLSSLVKKNISDDSDFEWLSQLRYYWQENHLETKMINAGLRYGYEYLGNSPRLVITPLTDRCYRTLFGALHLHLGGAPEGPAGTGKTETTKDLAKAVAKQCVVFNCSDGLDYLALGKFFKGLLSCGAWACFDEFNRIDLEVLSVVAQQILTIQRGINAGADILMFEGTELKLDPTCAVFITMNPGYAGRSELPDNLKALFRTVAMMVPDYAMIAEIVLYSCGFVTARPLSVKIVATYRLCSEQLSSQHHYDYGMRAVKSVLTAAGNLKLKYPNENEEILLLRSIIDVNLPKFLSHDLPLFEGITSDLFPGVKLPKPDYNDLLAAIKDNCASMNLQMTAFFSEKILQVYEMMIVRHGFMIVGEPFGGKTSAYRVLAGALNDICEKGLMEENKVQITVLNPKSVTMGQLYGQFDSVSHEWSDGVLAVSFRAFASSVTPDRKWLIFDGPVDAVWIENMNTVLDDNKKLCLMSGEIIQMSPQMNLIFEPMDLEVASPATVSRCGMIYMEPHMLGWRPLMLSWVNLLPASVSVIQKEFIMGLFDRMVPVSVEFIRKHTKELSPTSDTNLVRSLMNLIDCFMDDFADEVKLKERNDRETYSLLEGIFLFSLIWSVGASCTDDDRLKFNKILRELMESPISDRTRNTFKLQSGTEQTSSKALTVPFPEKGTIYDYQFVTEGIGKWEPWIKKLKEAPPIPKDVMFNEIIVPTLDTIRYSALMELLTTHQKPSIFVGPTGTGKSVYITNFLLNQLNKEIYKPLLINFSAQTTAAQTQNIVMSKLDKRRKGVFGPPLGKRMVVFVDDVNMPAREVYGAQPPIELLRQWLDHWNWYDLKDCSMIKLVDIQIMCAMGPPGGGRNPVTPRYMRHFNIITINEFSDKSMYTIFSRILTWHLEICYKFPDEFLDLTTQIVNGTMTLYKEAMKNLLPTPAKSHYLFNLRDFSRVIQGVCLSRPETTETTEVIKRLWVHEVLRVYYDRLLDNTDRSWLINYIQEILRNYMYEDFHELFQRLDFDNDGMVEADDLRSLMFCDFHDPKREDTNYREIADVDNLRMIVEIHLEEYNNISKKPMNLVLFRFAIEHISRISRILKQPRSHALLVGVGGSGRQSVTRLAAHMADYSVFQVEISKGYDTTEWHEDLKVILRKCAEGEMQGVFLFTDTQIKEESFLEDVSNLLNAGEIPNLFALDEKQEICDKMRQLDRQRDKTKQTDGSPIALFNMFIDHCRSQLHVVLAMSPIGDAFRNRLRKFPALVNCCTIDWFQSWPEDALQAVASRFLEEIEMSEEIRDGCIDMCKSFHTSTIDLSKSFFVELQRYNYVTPTSYLELISTFKLLLEKKRSEVMKMKKRYEVGLEKLDSASSQVATMQMELEALHPQLKVASKEVDEMMIMIEKESVEVAKTEKIVKADETIANEQAMASKAIKDECDADLAGALPILESALAALDTLTAQDITVVKSMKSPPAGVKLVMEAICILKGIKADKIPDPTGSGKKIEDFWGPAKRLLGDMRFLQSLHEYDKDNIPPAYMNIIRKNYIPNPDFVPEKIRNASTAAEGLCKWVIAMDSYDKVAKIVAPKKIKLAAAEGELKIAMDGLRKKQAALKEVQDKLARLQDTLELNKQKKADLENQVDLCSKKLERAEQLIGGLGGEKTRWSHTALELGQLYINLTGDILISSGVVAYLGAFTSTYRQNQTKEWTTLCKGRDIPCSDDCSLMGTLGEAVTIRTWNIAGLPSDSFSIDNGIIIMNARRWPLMIDPQSQANKWIKNMEKANSLYVIKLSEPDYVRTLENCIQFGTPVLLENVGEELDPILEPLLLKQTFKQGGSTCIRLGDSTIEYAPDFRFYITTKLRNPHYLPETSVKVTLLNFMITPEGMQDQLLGIVVAQERPDLEEEKQALILQGAENKRQLKEIEDKILEVLSSSEGNILEDETAIKILSSSKALANEISQKQEVAEETEKKIDTTRMGYRPIAIHSSILFFSLADLANIEPMYQYSLTWFINLFILSIENSEKSEILAKRLQILKDHFTYSLYVNVCRSLFEKDKLLFSFCLTINLLLHERAINKAEWRFLLTGGIGLDNPYANLCTWLPQKSWDEICRLDDLPAFKTIRREFMRLKDGWKKVYDSLEPHHEVFPEEWEDKANEFQRMLIIRCLRPDKVIPMLQEFIINRLGRAFIEPPPFDLAKAFGDSNCCAPLIFVLSPGADPMAALLKFADDQGYGGSKLSSLSLGQGQGPIAMKMLEKAVKEGTWVVLQNCHLATSWMPTLEKVCEELSPESTHPDFRMWLTSYPSPNFPVSVLQNGVKMTNEAPKGLRANIIRSYLMDPISDPEFFGSCKKPEEFKKLLYGLCFFHALVQERRKFGPLGWNIPYEFNETDLRISVQQLHMFLNQYEELPYEALRYMTGECNYGGRVTDDWDRRTLRSILNKFFNPELVENSDYKFDSSGIYFVPPSGDHKSYIEYTKTLPLTPAPEIFGMNANADITKDQSETQLLFDNILLTQSRSAGAGAKSSDEVVNEVASDILGKLPNNFDIEAAMRRYPTTYTQSMNTVLVQEMGRFNKLLKTIRDSCVNIQKAIKGLAVMSTDLEEVVSSILNVKIPEMWMGKSYPSLKPLGSYVNDFLARLKFLQQWYEVGPPPVFWLSGFFFTQAFLTGAQQNYARKYTIPIDLLGFDYEVMEDKEYKHPPEDGVFIHGLFLDGASWNRKIKKLAESHPKILYDTVPVMWLKPCKRADIPKRPSYVAPLYKTSERRGVLSTTGHSTNFVIAMTLPSDQPKEHWIGRGVALLCQLNS

SEQ ID NO: 26089 - protein, 501 aa, Homo sapiens
  Payload ID: 5160
  Gene Symbol: DNAH7
  Gene Name: dynein, axonemal, heavy chain 7
  Uniprot ID: Q8WXX0
  ENSP ID: ENSP00000386260
MSSEQDKSASKEKSKKPVRFLPQLSMEKLASKEKFKAPARALPQLSMVSTKPHWQQAAPSFHLSVKQDDESPEPFSVKNEQSHAEYMERFGKKGKLPHQVDDSYVGPSTSKSKGKSPHKERENFRSTLVNVIMQQDADLDSAVPDGSTIPKPTASAIEKDILRYYYYIHHGIDTDHVAPMEDSWLEHVLDLVPQHLKVFTDSIVTLSDEMREDYLLSVRKSIVDFVLKDPREKGDDKKTDELPAHRAEMEILPKPWRKSFLAASSYIRDHLNAMNPTMLAVLDLWHTNFKKLRLVDIKEFHNCQDALELSSFQNIIMRHMDSAKETLLKMWFPEVQNIYYQGNKKKQLPTGDSSAKLESFFNCAAALMTLQLQDLTLVSMQDFTDLIAQPPDSVRAFEHPGFIMRLILDNDTIKFEPELSDYIDIFLNVYDVMIKAVSFVPRVETKLYSKWRNKAKPGHFYFSHIQRSVTFQHSEVSSPQNSHFKIVSPFSVLGFTWRCQL

SEQ ID NO: 26090 - protein, 507 aa, Homo sapiens
  Payload ID: 5160
  Gene Symbol: DNAH7
  Gene Name: dynein, axonemal, heavy chain 7
  Uniprot ID: Q8WXX0
  ENSP ID: ENSP00000386912
MWLTSYPSPNFPVSVLQNGVKMTNEAPKGLRANIIRSYLMDPISDPEFFGSCKKPEEFKKLLYGLCFFHALVQERRKFGPLGWNIPYEFNETDLRISVQQLHMFLNQYEELPYEALRYMTGECNYGGRVTDDWDRRTLRSILNKFFNPELVENSDYKFDSSGIYFVPPSGDHKSYIEYTKTLPLTPAPEIFGMNANADITKDQSETQLLFDNILLTQSRSAGAGAKSSDEVVNEVASDILGKLPNNFDIEAAMRRYPTTYTQSMNTVLVQEMGRFNKLLKTIRDSCVNIQKAIKGLAVMSTDLEEVVSSILNVKIPEMWMGKSYPSLKPLGSYVNDFLARLKFLQQWYEVGPPPVFWLSGFFFTQAFLTGAQQNYARKYTIPIDLLGFDYEVMEDKEYKHPPEDGVFIHGLFLDGASWNRKIKKLAESHPKILYDTVPVMWLKPCKRADIPKRPSYVAPLYKTSERRGVLSTTGHSTNFVIAMTLPSDQPKEHWIGRGVALLCQLNS

SEQ ID NO: 26091 - protein, 121 aa, Homo sapiens
  Payload ID: 5160
  Gene Symbol: DNAH7
  Gene Name: dynein, axonemal, heavy chain 7
  ENSP ID: ENSP00000407444
MEKLASKEKFKAPARALPQLSMVSTKPHWQQAAPSFHLSVKQDDESPEPFSVKNEQSHAEYMERFGKKGKLPHQVDDSYVGPSTSKSKGKSPHKERENFRSTLVNVIMQQDADLDSAVPDG

SEQ ID NO: 26092 - protein, 56 aa, Homo sapiens
  Payload ID: 5160
  Gene Symbol: DNAH7
  Gene Name: dynein, axonemal, heavy chain 7
  ENSP ID: ENSP00000409732
YPSLKPLGSYVNDFLARLKFLQVFSFTDYFWMELPGIERSRNLQNRIPKFFMIQCL

SEQ ID NO: 26093 - protein, 4707 aa, Homo sapiens
  Payload ID: 5161
  Gene Symbol: DNAH8
  Gene Name: dynein, axonemal, heavy chain 8
  ENSP ID: ENSP00000333363
MEKDAEDGAPSEGAEAPPSTEEAAPPRSEEEEAPRPPTVEAPAEDGFSPSAEDAVSSVVDYRDLIPSEEGIVLPDDHEADLNRVRQRLAPRPVQSVISEVLSLPSSRRSSRYRRSMSGLPNLQETLKERQARFREARESRRLKIDPSYKYIFEILAENLGLDIVTVEELILDCPSLEAFTNFFAKDGCKTLKFLYQEGDVPGIECGRTIAGATKGAKMMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWIREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETGEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVEVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHAKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQIIMRVKLASCGFLENVILAQKFYVLYKLCEEQLTKQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNHKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNTVRYMIGEVQYGGRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISILRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAHKGWALDTVTIHNEVLRQTKEEITSPPGEGVYIYGLYMDGAAWDRRNGKLMESTPKVLFTQLPVLHIFAINSTAPKDPKLYVCPIYKKPRRTDLTFITVVYLRTVLSPDHWILRGVALLCDIK

SEQ ID NO: 26094 - protein, 4490 aa, Homo sapiens
  Payload ID: 5161
  Gene Symbol: DNAH8
  Gene Name: dynein, axonemal, heavy chain 8
  Uniprot ID: Q96JB1
  ENSP ID: ENSP00000352312
MMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWIREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETGEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVEVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHAKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQIIMRVKLASCGFLENVILAQKFYVLYKLCEEQLTKQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNHKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNTVRYMIGEVQYGGRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISILRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAHKGWALDTVTIHNEVLRQTKEEITSPPGEGVYIYGLYMDGAAWDRRNGKLMESTPKVLFTQLPVLHIFAINSTAPKDPKLYVCPIYKKPRRTDLTFITVVYLRTVLSPDHWILRGVALLCDIK

SEQ ID NO: 26095 - protein, 217 aa, Homo sapiens
  Payload ID: 5161
  Gene Symbol: DNAH8
  Gene Name: dynein, axonemal, heavy chain 8
  ENSP ID: ENSP00000362375
MEKDAEDGAPSEGAEAPPSTEEAAPPRSEEEEAPRPPTVEAPAEDGFSPSAEDAVSSVVDYRDLIPSEEGIVLPDDHEADLNRVRQRLAPRPVQSVISEVLSLPSSRRSSRYRRSMSGLPNLQETLKERQARFREARESRRLKIDPSYKYIFEILAENLGLDIVTVEELILDCPSLEAFTNFFAKDGCKTLKFLYQEGDVPGIECGRTIAGATKGAK

SEQ ID NO: 26096 - protein, 135 aa, Homo sapiens
  Payload ID: 5161
  Gene Symbol: DNAH8
  Gene Name: dynein, axonemal, heavy chain 8
  ENSP ID: ENSP00000377916
  MOD_RES (1)..(1): Any amino acid
XTARKERKKQFIFSDGDCVDLNPEFGIFLTMNPGYAGRQELPENLKIQFRTVAMMVPDRQVHYDFGLRNILSVLRTLGSQKRARPEDSELSIVMRGLRDMNLSKLVDEDEPLFLSLINDLFPGLQLDSNTYAELQ

SEQ ID NO: 26097 - protein, 4188 aa, Homo sapiens
  Payload ID: 5161
  Gene Symbol: DNAH8
  Gene Name: dynein, axonemal, heavy chain 8
  ENSP ID: ENSP00000415331
MEKDAEDGAPSEGAEAPPSTEEAAPPRSEEEEAPRPPTVEAPAEDGFSPSAEDAVSSVVDYRDLIPSEEGIVLPDDHEADLNRVRQRLAPRPVQSVISEVLSLPSSRRSSRYRRSMSGLPNLQETLKERQARFREARESRRLKIDPSYKYIFEILAENLGLDIVTVEELILDCPSLEAFTNFFAKDGCKTLKFLYQEGDVPGIECGRTIAGATKGAKMMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWIREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETGEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVEVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHAKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQIIMRVKLASCGFLENVILAQKFYVLYKLCEEQLTKQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNHKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQVCDKRLLLLQHYC

SEQ ID NO: 26098 - protein, 4486 aa, Homo sapiens
  Payload ID: 5162
  Gene Symbol: DNAH9
  Gene Name: dynein, axonemal, heavy chain 9
  Uniprot ID: Q9NYC9
  ENSP ID: ENSP00000262442
MRLAEERAALAAENADGEPGADRRLRLLGTYVAMSLRPAAGAWERCAGSAEAEQLLQAFLGRDAAEGPRPLLVVRPGPRGLAIRPGLEVGPESGLAGAKALFFLRTGPEPPGPDSFRGAVVCGDLPAAPLEHLAALFSEVVLPVLANEKNRLNWPHMICEDVRRHAHSLQCDLSVILEQVKGKTLLPLPAGSEKMEFADSKSETVLDSIDKSVIYAIESAVIKWSYQVQVVLKRESSQPLLQGENPTPKVELEFWKSRYEDLKYIYNQLRTITVRGMAKLLDKLQSSYFPAFKAMYRDVVAALAEAQDIHVHLIPLQRHLEALENAEFPEVKPQLRPLLHVVCLIWATCKSYRSPGRLTVLLQEICNLLIQQASNYLSPEDLLRSEVEESQRKLQVVSDTLSFFKQEFQDRRENLHTYFKENQEVKEWDFQSSLVFVRLDGFLGQLHVVEGLLKTALDFHKLGKVEFSGVRGNALSQQVQQMHEEFQEMYRLLSGSSSDCLYLQSTDFENDVSEFNQKVEDLDRRLGTIFIQAFDDAPGLEHAFKLLDIAGNLLERPLVARDTSDKYLVLIQMFNKDLDAVRMIYSQHVQEEAELGFSPVHKNMPTVAGGLRWAQELRQRIQGPFSNFGRITHPCMESAEGKRMQQKYEDMLSLLEKYETRLYEDWCRTVSEKSQYNLSQPLLKRDPETKEITINFNPQLISVLKEMSYLEPREMKHMPETAAAMFSSRDFYRQLVANLELMANWYNKVMKTLLEVEFPLVEEELQNIDLRLRAAEETLNWKTEGICDYVTEITSSIHDLEQRIQKTKDNVEEIQNIMKTWVTPIFKTKDGKRESLLSLDDRHDRMEKYYNLIKESGLKIHALVQENLGLFSADPTSNIWKTYVNSIDNLLLNGFFLAIECSLKYLLENTECKAGLTPIFEAQLSLAIPELVFYPSLESGVKGGFCDIVEGLITSIFRIPSLVPRLSPQNGSPHYQVDLDGIPDLANMRRTLMERVQRMMGLCCGYQSTFSQYSYLYVEDRKEVLGQFLLYGHILTPEEIEDHVEDGIPENPPLLSQFKVQIDSYETLYEEVCRLEPIKVFDGWMKIDIRPFKASLLNIIKRWSLLFKQHLVDHVTHSLANLDAFIKKSESGLLKKVEKGDFQGLVEIMGHLMAVKERQSNTDEMFEPLKQTIELLKTYEQELPETVFKQLEELPEKWNNIKKVAITVKQQVAPLQANEVTLLRQRCTAFDAEQQQFWEQFHKEAPFRFDSIHPHQMLDARHIEIQQMESTMASISESASLFEVNVPDYKQLRQCRKEVCQLKELWDTIGMVTSSIHAWETTPWRNINVEAMELECKQFARHIRNLDKEVRAWDAFTGLESTVWNTLSSLRAVAELQNPAIRERHWRQLMQATGVSFTMDQDTTLAHLLQLQLHHYEDEVRGIVDKAAKEMGMEKTLKELQTTWAGMEFQYEPHPRTNVPLLCSDEDLIEVLEDNQVQLQNLVMSKYVAFFLEEVSGWQKKLSTVDAVISIWFEVQRTWTHLESIFTGSEDIRAQLPQDSKRFEGIDIDFKELAYDAQKIPNVVQTTNKPGLYEKLEDIQGRLCLCEKALAEYLDTKRLAFPRFYFLSSSDLLDILSNGTAPQQVQRHLSKLFDNMAKMRFQLDASGEPTKTSLGMYSKEEEYVAFSEPCDCSGQVEIWLNHVLGHMKATVRHEMTEGVTAYEEKPREQWLFDHPAQVALTCTQIWWTTEVGMAFARLEEGYESAMKDYYKKQVAQLKTLITMLIGQLSKGDRQKIMTICTIDVHARDVVAKMIAQKVDNAQAFLWLSQLRHRWDDEVKHCFANICDAQFLYSYEYLGNTPRLVITPLTDRCYITLTQSLHLTMSGAPAGPAGTGKTETTKDLGRALGILVYVFNCSEQMDYKSCGNIYKGLAQTGAWGCFDEFNRISVEVLSVVAVQVKSIQDAIRDKKQWFSFLGEEISLNPSVGIFITMNPGYAGRTELPENLKSLFRPCAMVVPDFELICEIMLVAEGFIEAQSLARKFITLYQLCKELLSKQDHYDWGLRAIKSVLVVAGSLKRGDPDRPEDQVLMRSLRDFNIPKIVTDDMPIFMGLIGDLFPALDVPRRRDPNFEALVRKAIVDLKLQAEDNFVLKVVQLEELLAVRHSVFVVGGAGTGKSQVLRSLHKTYQIMKRRPVWTDLNPKAVTNDELFGIINPATGEWKDGLFSSIMRELANITHDGPKWILLDGDIDPMWIESLNTVMDDNKVLTLASNERIPLNPTMKLLFEISHLRTATPATVSRAGILYINPADLGWNPPVSSWIEKREIQTERANLTILFDKYLPTCLDTLRTRFKKIIPIPEQSMVQMVCHLLECLLTTEDIPADCPKEIYEHYFVFAAIWAFGGAMVQDQLVDYRAEFSKWWLTEFKTVKFPSQGTIFDYYIDPETKKFEPWSKLVPQFEFDPEMPLQACLVHTSETIRVCYFMERLMARQRPVMLVGTAGTGKSVLVGAKLASLDPEAYLVKNVPFNYYTTSAMLQAVLEKPLEKKAGRNYGPPGNKKLIYFIDDMNMPEVDAYGTVQPHTIIRQHLDYGHWYDRSKLSLKEITNVQYVSCMNPTAGSFTINPRLQRHFSVFVLSFPGADALSSIYSIILTQHLKLGNFPASLQKSIPPLIDLALAFHQKIATTFLPTGIKFHYIFNLRDFANIFQGILFSSVECVKSTWDLIRLYLHESNRVYRDKMVEEKDFDLFDKIQTEVLKKTFDDIEDPVEQTQSPNLYCHFANGIGEPKYMPVQSWELLTQTLVEALENHNEVNTVMDLVLFEDAMRHVCHINRILESPRGNALLVGVGGSGKQSLTRLAAFISSMDVFQITLRKGYQIQDFKMDLASLCLKAGVKNLNTVFLMTDAQVADERFLVLINDLLASGEIPDLYSDDEVENIISNVRNEVKSQGLVDNRENCWKFFIDRIRRQLKVTLCFSPVGNKLRVRSRKFPAIVNCTAIHWFHEWPQQALESVSLRFLQNTEGIEPTVKQSISKFMAFVHTSVNQTSQSYLSNEQRYNYTTPKSFLEFIRLYQSLLHRHRKELKCKTERLENGLLKLHSTSAQVDDLKAKLAAQEVELKQKNEDADKLIQVVGVETDKVSREKAMADEEEQKVAVIMLEVKQKQKDCEEDLAKAEPALTAAQAALNTLNKTNLTELKSFGSPPLAVSNVSAAVMVLMAPRGRVPKDRSWKAAKVTMAKVDGFLDSLINFNKENIHENCLKAIRPYLQDPEFNPEFVATKSYAAAGLCSWVINIVRFYEVFCDVEPKRQALNKATADLTAAQEKLAAIKAKIAHLNENLAKLTARFEKATADKLKCQQEAEVTAVTISLANRLVGGLASENVRWADAVQNFKQQERTLCGDILLITAFISYLGFFTKKYRQSLLDRTWRPYLSQLKTPIPVTPALDPLRMLMDDADVAAWQNEGLPADRMSVENATILINCERWPLMVDPQLQGIKWIKNKYGEDLRVTQIGQKGYLQIIEQALEAGAVVLIENLEESIDPVLGPLLGREVIKKGRFIKIGDKECEYNPKFRLILHTKLANPHYQPELQAQATLINFTVTRDGLEDQLLAAVVSMERPDLEQLKSDLTKQQNGFKITLKTLEDSLLSRLSSASGNFLGETVLVENLEITKQTAAEVEKKVQEAKVTEVKINEAREHYRPAAARASLLYFIMNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQNIHLVAKWLSTLEKKLEEHSENSHPEFRVFMSAEPAPSPEGHIIPQGILENSIKITNEPPTGMHANLHKALDNFTQDTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEFRSPPREGAYIHGLFMEGACWDTQAGIITEAKLKDLTPPMPVMFIKAIPADKQDCRSVYSCPVYKTSQRGPTYVWTFNLKTKENPSKWVLAGVALLLQI

SEQ ID NO: 26099 - protein, 4410 aa, Homo sapiens
  Payload ID: 5162
  Gene Symbol: DNAH9
  Gene Name: dynein, axonemal, heavy chain 9
  ENSP ID: ENSP00000414874
MRLAEERAALAAENADGEPGADRRLRLLGTYVAMSLRPAAGAWERCAGSAEAEQLLQAFLGRDAAEGPRPLLVVRPGPRGLAIRPGLEVGPESGLAGAKALFFLRTGPEPPGPDSFRGAVVCGDLPAAPLEHLAALFSEVVLPVLANEKNRLNWPHMICEDVRRHAHSLQCDLSVILEQVKGKTLLPLPAGSEKMEFADSKSETVLDSIDKSVIYAIESAVIKWSYQVQVVLKRESSQPLLQGENPTPKVELEFWKSRYEDLKYIYNQLRTITVRGMAKLLDKLQSSYFPAFKAMYRDVVAALAEAQDIHVHLIPLQRHLEALENAEFPEVKPQLRPLLHVVCLIWATCKSYRSPGRLTVLLQEICNLLIQQASNYLSPEDLLRSEVEESQRKLQVVSDTLSFFKQEFQDRRENLHTYFKENQEVKEWDFQSSLVFVRLDGFLGQLHVVEGLLKTALDFHKLGKVEFSGVRGNALSQQVQQMHEEFQEMYRLLSGSSSDCLYLQSTDFENDVSEFNQKVEDLDRRLGTIFIQAFDDAPGLEHAFKLLDIAGNLLERPLVARDTSDKYLVLIQMFNKDLDAVRMIYSQHVQEEAELGFSPVHKNMPTVAGGLRWAQELRQRIQGPFSNFGRITHPCMESAEGKRMQQKYEDMLSLLEKYETRLYEDWCRTVSEKSQYNLSQPLLKRDPETKEITINFNPQLISVLKEMSYLEPREMKHMPETAAAMFSSRDFYRQLVANLELMANWYNKVMKTLLEVEFPLVEEELQNIDLRLRAAEETLNWKTEGICDYVTEITSSIHDLEQRIQKTKDNVEEIQNIMKTWVTPIFKTKDGKRESLLSLDDRHDRMEKYYNLIKESGLKIHALVQENLGLFSADPTSNIWKTYVNSIDNLLLNGFFLAIECSLKYLLENTECKAGLTPIFEAQLSLAIPELVFYPSLESGVKGGFCDIVEGLITSIFRIPSLVPRLSPQNGSPHYQVDLDGIPDLANMRRTLMERVQRMMGLCCGYQSTFSQYSYLYVEDRKEVLGQFLLYGHILTPEEIEDHVEDGIPENPPLLSQFKVQIDSYETLYEEVCRLEPIKVFDGWMKIDIRPFKASLLNIIKRWSLLFKQHLVDHVTHSLANLDAFIKKSESGLLKKVEKGDFQGLVEIMGHLMAVKERQSNTDEMFEPLKQTIELLKTYEQELPETVFKQLEELPEKWNNIKKVAITVKQQVAPLQANEVTLLRQRCTAFDAEQQQFWEQFHKEAPFRFDSIHPHQMLDARHIEIQQMESTMASISESASLFEVNVPDYKQLRQCRKEVCQLKELWDTIGMVTSSIHAWETTPWRNINVEAMELECKQFARHIRNLDKEVRAWDAFTGLESTVWNTLSSLRAVAELQNPAIRERHWRQLMQATGVSFTMDQDTTLAHLLQLQLHHYEDEVRGIVDKAAKEMGMEKTLKELQTTWAGMEFQYEPHPRTNVPLLCSDEDLIEVLEDNQVQLQNLVMSKYVAFFLEEVSGWQKKLSTVDAVISIWFEVQRTWTHLESIFTGSEDIRAQLPQDSKRFEGIDIDFKELAYDAQKIPNVVQTTNKPGLYEKLEDIQGRLCLCEKALAEYLDTKRLAFPRFYFLSSSDLLDILSNGTAPQQVQRHLSKLFDNMAKMRFQLDASGEPTKTSLGMYSKEEEYVAFSEPCDCSGQVEIWLNHVLGHMKATVRHEMTEGVTAYEEKPREQWLFDHPAQVALTCTQIWWTTEVGMAFARLEEGYESAMKDYYKKQVAQLKTLITMLIGQLSKGDRQKIMTICTIDVHARDVVAKMIAQKVDNAQAFLWLSQLRHRWDDEVKHCFANICDAQFLYSYEYLGNTPRLVITPLTDRCYITLTQSLHLTMSGAPAGPAGTGKTETTKDLGRALGILVYVFNCSEQMDYKSCGNIYKGLAQTGAWGCFDEFNRISVEVLSVVAVQVKSIQDAIRDKKQWFSFLGEEISLNPSVGIFITMNPGYAGRTELPENLKSLFRPCAMVVPDFELICEIMLVAEGFIEAQSLARKFITLYQLCKELLSKQDHYDWGLRAIKSVLVVAGSLKRGDPDRPEDQVLMRSLRDFNIPKIVTDDMPIFMGLIGDLFPALDVPRRRDPNFEALVRKAIVDLKLQAEDNFVLKVVQLEELLAVRHSVFVVGGAGTGKSQVLRSLHKTYQIMKRRPVWTDLNPKAVTNDELFGIINPATGEWKDGLFSSIMRELANITHDGPKWILLDGDIDPMWIESLNTVMDDNKVLTLASNERIPLNPTMKLLFEISHLRTATPATVSRAGILYINPADLGWNPPVSSWIEKREIQTERANLTILFDKYLPTCLDTLRTRFKKIIPIPEQSMVQMVCHLLECLLTTEDIPADCPKEIYEHYFVFAAIWAFGGAMVQDQLVDYRAEFSKWWLTEFKTVKFPSQGTIFDYYIDPETKKFEPWSKLVPQFEFDPEMPLQACLVHTSETIRVCYFMERLMARQRPVMLVGTAGTGKSVLVGAKLASLDPEAYLVKNVPFNYYTTSAMLQAVLEKPLEKKAGRNYGPPGNKKLIYFIDDMNMPEVDAYGTVQPHTIIRQHLDYGHWYDRSKLSLKEITNVQYVSCMNPTAGSFTINPRLQRHFSVFVLSFPGADALSSIYSIILTQHLKLGNFPASLQKSIPPLIDLALAFHQKIATTFLPTGIKFHYIFNLRDFANIFQGILFSSVECVKSTWDLIRLYLHESNRVYRDKMVEEKDFDLFDKIQTEVLKKTFDDIEDPVEQTQSPNLYCHFANGIGEPKYMPVQSWELLTQTLVEALENHNEVNTVMDLVLFEDAMRHVCHINRILESPRGNALLVGVGGSGKQSLTRLAAFISSMDVFQITLRKGYQIQDFKMDLASLCLKAGVKNLNTVFLMTDAQVADERFLVLINDLLASGEIPDLYSDDEVENIISNVRNEVKSQGLVDNRENCWKFFIDRIRRQLKVTLCFSPVGNKLRVRSRKFPAIVNCTAIHWFHEWPQQALESVSLRFLQNTEGIEPTVKQSISKFMAFVHTSVNQTSQSYLSNEQRYNYTTPKSFLEFIRLYQSLLHRHRKELKCKTERLENGLLKLHSTSAQVDDLKAKLAAQEVELKQKNEDADKLIQVVGVETDKVSREKAMADEEEQKVAVIMLEVKQKQKDCEEDLAKAEPALTAAQAALNTLNKTNLTELKSFGSPPLAVSNVSAAVMVLMAPRGRVPKDRSWKAAKVTMAKVDGFLDSLINFNKENIHENCLKAIRPYLQDPEFNPEFVATKSYAAAGLCSWVINIVRFYEVFCDVEPKRQALNKATADLTAAQEKLAAIKAKIAHLNENLAKLTARFEKATADKLKCQQEAEVTAVTISLANRLVGGLASENVRWADAVQNFKQQERTLCGDILLITAFISYLGFFTKKYRQSLLDRTWRPYLSQLKTPIPVTPALDPLRMLMDDADVAAWQNEGLPADRMSVENATILINCERWPLMVDPQLQGIKWIKNKYGEDLRVTQIGQKGYLQIIEQALEAGAVVLIENLEESIDPVLGPLLGREVIKKGRFIKIGDKECEYNPKFRLILHTKLANPHYQPELQAQATLINFTVTRDGLEDQLLAAVVSMERPDLEQLKSDLTKQQNGFKITLKTLEDSLLSRLSSASGNFLGETVLVENLEITKQTAAEVEKKVQEAKVTEVKINEAREHYRPAAARASLLYFIMNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQDTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEFRSPPREGAYIHGLFMEGACWDTQAGIITEAKLKDLTPPMPVMFIKAIPADKQDCRSVYSCPVYKTSQRGPTYVWTFNLKTKENPSKWVLAGVALLLQI

SEQ ID NO: 26100 - protein, 284 aa, Homo sapiens
  Payload ID: 5162
  Gene Symbol: DNAH9
  Gene Name: dynein, axonemal, heavy chain 9
  ENSP ID: ENSP00000463622
NVSAAVMVLMAPRGRVPKDRSWKAAKVTMAKVDGFLDSLINFNKENIHENCLKAIRPYLQDPEFNPEFVATKSYAAAGLCSWVINIVRFYEVFCDVEPKRQALNKATADLTAAQEKLAAIKAKIAHLNENLAKLTARFEKATADKLKCQQEAEVTAVTISLANRLTPIPVTPALDPLRMLMDDADVAAWQNEGLPADRMSVENATILINCERWPLMVDPQLQGIKWIKNKYGEDLRVTQIGQKGYLQIIEQALEAGAVVLIENLEESIDPVLGPLLGREVIKKG

SEQ ID NO: 26101 - protein, 319 aa, Homo sapiens
  Payload ID: 5162
  Gene Symbol: DNAH9
  Gene Name: dynein, axonemal, heavy chain 9
  ENSP ID: ENSP00000463782
MRLAEERAALAAENADGEPGADRRLRLLGTYVAMSLRPAAGAWERCAGSAEAEQLLQAFLGRDAAEGPRPLLVVRPGPRGLAIRPGLEVGPESGLAGAKALFFLRTGPEPPGPDSFRGAVVCGDLPAAPLEHLAALFSEVVLPVLANEKNRLNWPHMICEDVRRHAHSLQCDLSVILEQVKGKTLLPLPAGSEKMEFADSKSETVLDSIDKSVIYAIESAVIKWSYQVQVVLKRESSQPLLQGENPTPKVELEFWKSRYEDLKYIYNQLRTITVRGMAKLLDKLQSSYFPAFKAMYRDVVAGEDQQVFSQMCLTQVTVE

SEQ ID NO: 26102 - protein, 87 aa, Homo sapiens
  Payload ID: 5162
  Gene Symbol: DNAH9
  Gene Name: dynein, axonemal, heavy chain 9
  ENSP ID: ENSP00000466691
PTPKVELEFWKSRYEDLKYIYNQLRTITVRGMAKLLDKLQSSYFPAFKAMYRDVVADGTAISWPFEHQTRSTLIKIAKPAKSMIRSR

SEQ ID NO: 26103 - protein, 43 aa, Homo sapiens
  Payload ID: 5162
  Gene Symbol: DNAH9
  Gene Name: dynein, axonemal, heavy chain 9
  ENSP ID: ENSP00000467192
YRDVVAAPFCIFYSYCQMGLQFPGHLSTRQDLRLSKLPSQQSL

SEQ ID NO: 26104 - protein, 798 aa, Homo sapiens
  Payload ID: 5162
  Gene Symbol: DNAH9
  Gene Name: dynein, axonemal, heavy chain 9
  Uniprot ID: Q9NYC9
  ENSP ID: ENSP00000476951
MNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQNIHLVAKWLSTLEKKLEEHSENSHPEFRVFMSAEPAPSPEGHIIPQGILENSIKITNEPPTGMHANLHKALDNFTQDTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEFRSPPREGAYIHGLFMEGACWDTQAGIITEAKLKDLTPPMPVMFIKAIPADKQDCRSVYSCPVYKTSQRGPTYVWTFNLKTKENPSKWVLAGVALLLQI

SEQ ID NO: 26105 - protein, 699 aa, Homo sapiens
  Payload ID: 5163
  Gene Symbol: DNAI1
  Gene Name: dynein, axonemal, intermediate chain 1
  Uniprot ID: Q9UI46
  ENSP ID: ENSP00000242317
MIPASAKAPHKQPHKQSISIGRGTRKRDEDSGTEVGEGTDEWAQSKATVRPPDQLELTDAELKEEFTRILTANNPHAPQNIVRYSFKEGTYKPIGFVNQLAVHYTQVGNLIPKDSDEGRRQHYRDELVAGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQDFKYYDDAADEYRDQVGTLLPLWKFQNDKAKRLSVTALCWNPKYRDLFAVGYGSYDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKIYKCSKSYSSQFLDTYDAHNMSVDTVSWNPYHTKVFMSCSSDWTVKIWDHTIKTPMFIYDLNSAVGDVAWAPYSSTVFAAVTTDGKAHIFDLAINKYEAICNQPVAAKKNRLTHVQFNLIHPIIIVGDDRGHIISLKLSPNLRKMPKEKKGQEVQKGPAVEIAKLDKLLNLVREVKIKT

SEQ ID NO: 26106 - protein, 289 aa, Homo sapiens
  Payload ID: 5163
  Gene Symbol: DNAI1
  Gene Name: dynein, axonemal, intermediate chain 1
  ENSP ID: ENSP00000395396
MIPASAKAPHKQPHKQDEDSGTEVGEGTDEWAQSKATVRPPDQLELTDAELKEEFTRILTANNPHAPQNIVRYSFKEGTYKPIGFVNQLAVHYTQVGNLIPKDSDEGRRQHYRDELVAGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQ

SEQ ID NO: 26107 - protein, 142 aa, Homo sapiens
  Payload ID: 5163
  Gene Symbol: DNAI1
  Gene Name: dynein, axonemal, intermediate chain 1
  ENSP ID: ENSP00000408129
  MOD_RES (1)..(1): Any amino acid
XCGTAFDFHKEIDYMFLVGTEEGKIYKCSKSYSSQFLDTYDAHNMSVDTVSWNPYHTKVFMSCSSDWTVKIWDHTIKTPMFIYDLNSAVGDVAWAPYSSTVFAAVTTDGKEKKGQEVQKGPAVEIAKLDKLLNLVREVKIKT

SEQ ID NO: 26108 - protein, 175 aa, Homo sapiens
  Payload ID: 5163
  Gene Symbol: DNAI1
  Gene Name: dynein, axonemal, intermediate chain 1
  ENSP ID: ENSP00000434296
  MOD_RES (1)..(1): Any amino acid
XDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKIYKDPDVHL

SEQ ID NO: 26109 - protein, 703 aa, Homo sapiens
  Payload ID: 5163
  Gene Symbol: DNAI1
  Gene Name: dynein, axonemal, intermediate chain 1
  ENSP ID: ENSP00000480538
MIPASAKAPHKQPHKQSISIGRGTRKRDEDSGTEVGEGTDEWAQSKATVRPPDQLELTDAELKEEFTRILTANNPHAPQNIVRYSFKEGTYKPIGFVNQLAVHYTQVGNLIPKDSDEGRRQHYRDELVAVSYQGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQDFKYYDDAADEYRDQVGTLLPLWKFQNDKAKRLSVTALCWNPKYRDLFAVGYGSYDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKIYKCSKSYSSQFLDTYDAHNMSVDTVSWNPYHTKVFMSCSSDWTVKIWDHTIKTPMFIYDLNSAVGDVAWAPYSSTVFAAVTTDGKAHIFDLAINKYEAICNQPVAAKKNRLTHVQFNLIHPIIIVGDDRGHIISLKLSPNLRKMPKEKKGQEVQKGPAVEIAKLDKLLNLVREVKIKT

SEQ ID NO: 26110 - protein, 605 aa, Homo sapiens
  Payload ID: 5164
  Gene Symbol: DNAI2
  Gene Name: dynein, axonemal, intermediate chain 2
  Uniprot ID: Q9GZS0
  ENSP ID: ENSP00000308312
MEIVYVYVKKRSEFGKQCNFSDRQAELNIDIMPNPELAEQFVERNPVDTGIQCSISMSEHEANSERFEMETRGVNHVEGGWPKDVNPLELEQTIRFRKKVEKDENYVNAIMQLGSIMEHCIKQNNAIDIYEEYFNDEEAMEVMEEDPSAKTINVFRDPQEIKRAATHLSWHPDGNRKLAVAYSCLDFQRAPVGMSSDSYIWDLENPNKPELALKPSSPLVTLEFNPKDSHVLLGGCYNGQIACWDTRKGSLVAELSTIESSHRDPVYGTIWLQSKTGTECFSASTDGQVMWWDIRKMSEPTEVVILDITKKEQLENALGAISLEFESTLPTKFMVGTEQGIVISCNRKAKTSAEKIVCTFPGHHGPIYALQRNPFYPKNFLTVGDWTARIWSEDSRESSIMWTKYHMAYLTDAAWSPVRPTVFFTTRMDGTLDIWDFMFEQCDPTLSLKVCDEALFCLRVQDNGCLIACGSQLGTTTLLEVSPGLSTLQRNEKNVASSMFERETRREKILEARHREMRLKEKGKAEGRDEEQTDEELAVDLEALVSKAEEEFFDIIFAELKKKEADAIKLTPVPQQPSPEEDQVVEEGEEAAGEEGDEEVEEDLA

SEQ ID NO: 26111 - protein, 605 aa, Homo sapiens; identical to SEQ ID NO: 26110
  Payload ID: 5164
  Gene Symbol: DNAI2
  Gene Name: dynein, axonemal, intermediate chain 2
  Uniprot ID: Q9GZS0
  ENSP ID: ENSP00000400252

SEQ ID NO: 26112 - protein, 593 aa, Homo sapiens
  Payload ID: 5164
  Gene Symbol: DNAI2
  Gene Name: dynein, axonemal, intermediate chain 2
  Uniprot ID: Q9GZS0
  ENSP ID: ENSP00000461950
MEIVYVYVKKRSEFGKQCNFSDRQAELNIDIMPNPELAEQFVERNPVDTGIQCSISMSEHEANSERFEMETRGVNHVEGGWPKDVNPLELEQTIRFRKKVEKDENYVNAIMQLGSIMEHCIKQNNAIDIYEEYFNDEEAMEVMEEDPSAKTINVFRDPQEIKRAATHLSWHPDGNRKLAVAYSCLDFQRAPVGMSSDSYIWDLENPNKPELALKPSSPLVTLEFNPKDSHVLLGGCYNGQIACWDTRKGSLVAELSTIESSHRDPVYGTIWLQSKTGTECFSASTDGQVMWWDIRKMSEPTEVVILDITKKEQLENALGAISLEFESTLPTKFMVGTEQGIVISCNRKAKTSAEKIVCTFPGHHGPIYALQRNPFYPKNFLTVGDWTARIWSEDSRESSIMWTKYHMAYLTDAAWSPVRPTVFFTTRMDGTLDIWDFMFEQCDPTLSLKDNGCLIACGSQLGTTTLLEVSPGLSTLQRNEKNVASSMFERETRREKILEARHREMRLKEKGKAEGRDEEQTDEELAVDLEALVSKAEEEFFDIIFAELKKKEADAIKLTPVPQQPSPEEDQVVEEGEEAAGEEGDEEVEEDLA

SEQ ID NO: 26113 - protein, 168 aa, Homo sapiens
  Payload ID: 5164
  Gene Symbol: DNAI2
  Gene Name: dynein, axonemal, intermediate chain 2
  ENSP ID: ENSP00000462767
MEIVYVYVKKRSEFGKQCNFSDRQAELNIDIMPNPELAEQFVERNPVDTGIQCSISMSEHEANSERFEMETRGVNHVEGGWPKDVNPLELEQTIRFRKKVEKDENYVNAIMQLGSGPPGNQEGCHTPLLAPRWQQEVGSGILLLGFSAGTCGHEQRFIHLGPGKPQQA

SEQ ID NO: 26114 - protein, 662 aa, Homo sapiens
  Payload ID: 5164
  Gene Symbol: DNAI2
  Gene Name: dynein, axonemal, intermediate chain 2
  ENSP ID: ENSP00000464197
MRMQLLDKFLGSPHHPLLPAPTRLRTWSCPGRTCGDREGAGGVPHPTPSLCPPAAGTMEIVYVYVKKRSEFGKQCNFSDRQAELNIDIMPNPELAEQFVERNPVDTGIQCSISMSEHEANSERFEMETRGVNHVEGGWPKDVNPLELEQTIRFRKKVEKDENYVNAIMQLGSIMEHCIKQNNAIDIYEEYFNDEEAMEVMEEDPSAKTINVFRDPQEIKRAATHLSWHPDGNRKLAVAYSCLDFQRAPVGMSSDSYIWDLENPNKPELALKPSSPLVTLEFNPKDSHVLLGGCYNGQIACWDTRKGSLVAELSTIESSHRDPVYGTIWLQSKTGTECFSASTDGQVMWWDIRKMSEPTEVVILDITKKEQLENALGAISLEFESTLPTKFMVGTEQGIVISCNRKAKTSAEKIVCTFPGHHGPIYALQRNPFYPKNFLTVGDWTARIWSEDSRESSIMWTKYHMAYLTDAAWSPVRPTVFFTTRMDGTLDIWDFMFEQCDPTLSLKVCDEALFCLRVQDNGCLIACGSQLGTTTLLEVSPGLSTLQRNEKNVASSMFERETRREKILEARHREMRLKEKGKAEGRDEEQTDEELAVDLEALVSKAEEEFFDIIFAELKKKEADAIKLTPVPQQPSPEEDQVVEEGEEAAGEEGDEEVEEDLA

SEQ ID NO: 26115 - protein, 77 aa, Homo sapiens
  Payload ID: 5165
  Gene Symbol: DNAL1
  Gene Name: dynein, axonemal, light chain 1
  Uniprot ID: Q4LDG9
  ENSP ID: ENSP00000310360
MKKLKILYMSNNLVKDWAEFVKLAELPCLEDLVFVGNPLEEKHSAENNWIEEATKRVPKLKKLDGTPVIKGDEEEDN

SEQ ID NO: 26116 - protein, 103 aa, Homo sapiens
  Payload ID: 5165
  Gene Symbol: DNAL1
  Gene Name: dynein, axonemal, light chain 1
  ENSP ID: ENSP00000450744
MEAVGDTLEELWISYNFIEKLKGIHIMKKLKILYMSNNLVKDWAEFVKLAELPCLEDLVFVGNPLEEKHSAENNWIEEATKRVPKLKKLDGTPVIKGDEEEDN

SEQ ID NO: 26117 - protein, 52 aa, Homo sapiens
  Payload ID: 5165
  Gene Symbol: DNAL1
  Gene Name: dynein, axonemal, light chain 1
  ENSP ID: ENSP00000451101
MDASLSMLANCEKLSLSTNCIEKIANLNGLKNLRILSLGRNNIKNLNGLEAV

SEQ ID NO: 26118 - protein, 67 aa, Homo sapiens
  Payload ID: 5165
  Gene Symbol: DNAL1
  Gene Name: dynein, axonemal, light chain 1
  ENSP ID: ENSP00000451264
QRPSEAKEIKLYAQIPPIEKMDASLSMLANCEKLSLSTNCIEKIANLNGLRGSRGHIRRTVDLLQFY

SEQ ID NO: 26119 - protein, 138 aa, Homo sapiens
  Payload ID: 5165
  Gene Symbol: DNAL1
  Gene Name: dynein, axonemal, light chain 1
  ENSP ID: ENSP00000451547
MDASLSMLANCEKLSLSTNCIEKIANLNGLKNLRILSLGRNNIKNLNGLEAVGDTLEELWISYNFIEKLKGIHIMKKLKILYMSNNLVKDWAEFVKLAELPCLEDLVFVGNPLEEKHSAENNWIEEATKRVPKLKKLD

SEQ ID NO: 26120 - protein, 151 aa, Homo sapiens
  Payload ID: 5165
  Gene Symbol: DNAL1
  Gene Name: dynein, axonemal, light chain 1
  Uniprot ID: Q4LDG9
  ENSP ID: ENSP00000451834
MDASLSMLANCEKLSLSTNCIEKIANLNGLKNLRILSLGRNNIKNLNGLEAVGDTLEELWISYNFIEKLKGIHIMKKLKILYMSNNLVKDWAEFVKLAELPCLEDLVFVGNPLEEKHSAENNWIEEATKRVPKLKKLDGTPVIKGDEEEDN

SEQ ID NO: 26121 - protein, 190 aa, Homo sapiens
  Payload ID: 5165
  Gene Symbol: DNAL1
  Gene Name: dynein, axonemal, light chain 1
  Uniprot ID: Q4LDG9
  ENSP ID: ENSP00000452037
MAKATTIKEALARWEEKTGQRPSEAKEIKLYAQIPPIEKMDASLSMLANCEKLSLSTNCIEKIANLNGLKNLRILSLGRNNIKNLNGLEAVGDTLEELWISYNFIEKLKGIHIMKKLKILYMSNNLVKDWAEFVKLAELPCLEDLVFVGNPLEEKHSAENNWIEEATKRVPKLKKLDGTPVIKGDEEEDN

SEQ ID NO: 26122 - protein, 57 aa, Homo sapiens
  Payload ID: 5165
  Gene Symbol: DNAL1
  Gene Name: dynein, axonemal, light chain 1
  ENSP ID: ENSP00000452368
MKKLKILYMSNNLVKDWAEFVKLAELPCLEDLVFVGNPLEEKHSAENNWIEEATKRV

SEQ ID NO: 26123 - protein, 65 aa, Homo sapiens
  Payload ID: 5165
  Gene Symbol: DNAL1
  Gene Name: dynein, axonemal, light chain 1
  ENSP ID: ENSP00000453439
MKKLKILYMSNNLVKDWAEFVKLAELPCLEDLVFVGNPLEEKHSAENNWIEEATKRVPKLKKLDG

SEQ ID NO: 26124 - protein, 105 aa, Homo sapiens
  Payload ID: 5166
  Gene Symbol: DNAL4
  Gene Name: dynein, axonemal, light chain 4
  Uniprot ID: O96015
  ENSP ID: ENSP00000216068
MGETEGKKDEADYKRLQTFPLVRHSDMPEEMRVETMELCVTACEKFSNNNESAAKMIKETMDKKFGSSWHVVIGEGFGFEITHEVKNLLYLYFGGTLAVCVWKCS

SEQ ID NO: 26125 - protein, 68 aa, Homo sapiens
  Payload ID: 5166
  Gene Symbol: DNAL4
  Gene Name: dynein, axonemal, light chain 4
  ENSP ID: ENSP00000385712
MGETEGKKDEADYKRLQTFPLVRHSDMPEEMRVETMELCVTACEKFSNNNEVLPAVQAAPRAFDGPCG

SEQ ID NO: 26126 - protein, 280 aa, Homo sapiens
  Payload ID: 5167
  Gene Symbol: DNALI1
  Gene Name: dynein, axonemal, light intermediate chain 1
  Uniprot ID: O14645
  ENSP ID: ENSP00000296218
MVTANKAHTGQGSCWVATLASAMIPPADSLLKYDTPVLVSRNTEKRSPKARLLKVSPQQPGPSGSAPQPPKTKLPSTPCVPDPTKQAEEILNAILPPREWVEDTQLWIQQVSSTPSTRMDVVHLQEQLDLKLQQRQARETGICPVRRELYSQCFDELIREVTINCAERGLLLLRVRDEIRMTIAAYQTLYESSVAFGMRKALQAEQGKSDMERKIAELETEKRDLERQVNEQKAKCEATEKRESERRQVEEKKHNEEIQFLKRTNQQLKAQLEGIIAPKK

SEQ ID NO: 26127 - protein, 4646 aa, Homo sapiens [sequence omitted]

SEQ ID NO: 26128 - protein, 180 aa, Homo sapiens
  Payload ID: 5168
  Gene Symbol: DYNC1H1
  Gene Name: dynein, cytoplasmic 1, heavy chain 1
  ENSP ID: ENSP00000450674
  MOD_RES (1)..(1): Any amino acid
XQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQVEFPPDLCSRVTFVNFTVTRSSLQSQCLNEVLKAERPDVDEKRSDLLKLQGEFQLRLRQLEKSLLQAL

SEQ ID NO: 26129 - protein, 645 aa, Homo sapiens
  Payload ID: 5169
  Gene Symbol: DYNC1I1
  Gene Name: dynein, cytoplasmic 1, intermediate chain 1
  Uniprot ID: O14576
  ENSP ID: ENSP00000320130
MSDKSDLKAELERKKQRLAQIREEKKRKEEERKKKEADMQQKKEPVQDDSDLDRKRRETEALLQSIGISPEPPLVQPLHFLTWDTCYFHYLVPTPMSPSSKSVSTPSEAGSQDSGDLGPLTRTLQWDTDPSVLQLQSDSELGRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 26130 - protein, 608 aa, Homo sapiens
  Payload ID: 5169
  Gene Symbol: DYNC1I1
  Gene Name: dynein, cytoplasmic 1, intermediate chain 1
  Uniprot ID: O14576
  ENSP ID: ENSP00000352348
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 26131 - protein, 628 aa, Homo sapiens
  Payload ID: 5169
  Gene Symbol: DYNC1I1
  Gene Name: dynein, cytoplasmic 1, intermediate chain 1
  Uniprot ID: O14576
  ENSP ID: ENSP00000392337
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRTLQWDTDPSVLQLQSDSELGRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 26132 - protein, 625 aa, Homo sapiens
  Payload ID: 5169
  Gene Symbol: DYNC1I1
  Gene Name: dynein, cytoplasmic 1, intermediate chain 1
  Uniprot ID: O14576
  ENSP ID: ENSP00000398118
MSDKSDLKAELERKKQRLAQIREEKKRKEEERKKKEADMQQKKEPVQDDSDLDRKRRETEALLQSIGISPEPPLVQPLHFLTWDTCYFHYLVPTPMSPSSKSVSTPSEAGSQDSGDLGPLTRRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGELAVPHNDEWTRFARTLVEIRANRADSEEEGTVELSA

SEQ ID NO: 26133 - protein, 116 aa, Homo sapiens
  Payload ID: 5169
  Gene Symbol: DYNC1I1
  Gene Name: dynein, cytoplasmic 1, intermediate chain 1
  ENSP ID: ENSP00000411957
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRDEALLYSPGWS

SEQ ID NO: 26134 - protein, 628 aa, Homo sapiens; identical to SEQ ID NO: 26131
  Payload ID: 5169
  Gene Symbol: DYNC1I1
  Gene Name: dynein, cytoplasmic 1, intermediate chain 1
  Uniprot ID: O14576
  ENSP ID: ENSP00000412444

SEQ ID NO: 26135 - protein, 128 aa, Homo sapiens
  Payload ID: 5169
  Gene Symbol: DYNC1I1
  Gene Name: dynein, cytoplasmic 1, intermediate chain 1
  ENSP ID: ENSP00000428273
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRTLQWDTDPSVLQLQSDSELGYMS

SEQ ID NO: 26136 - protein, 85 aa, Homo sapiens
  Payload ID: 5169
  Gene Symbol: DYNC1I1
  Gene Name: dynein, cytoplasmic 1, intermediate chain 1
  ENSP ID: ENSP00000428934
MSDKSDLKAELERKKQRLAQIREEKKRKEEERKKKEADMQQKKEPVQDDSDLDRKRRETEALLQSIGISPEPPLVPTPMSPSSKS

SEQ ID NO: 26137 - protein, 544 aa, Homo sapiens
  Payload ID: 5169
  Gene Symbol: DYNC1I1
  Gene Name: dynein, cytoplasmic 1, intermediate chain 1
  ENSP ID: ENSP00000438377
MSPSSKSVSTPSEAGSQDSGDLGPLTRTLQWDTDPSVLQLQSDSELGRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGEGLAMLPGWSQNSWTQAILLCWPPKVLGLQT

SEQ ID NO: 26138 - protein, 602 aa, Homo sapiens
  Payload ID: 5169
  Gene Symbol: DYNC1I1
  Gene Name: dynein, cytoplasmic 1, intermediate chain 1
  Uniprot ID: O14576
  ENSP ID: ENSP00000486363
MSDKSDLKAELERKKQRLAQIREEKKRKEEERKKKEADMQQKKEPVQDDSDLDRKRRETEALLQSIGISPEPPLVPTPMSPSSKSVSTPSEAGSQDSGDLGPLTRRRLHKLGVSKVTQVDFLPREVVSYSKETQTPLATHQSEEDEEDEEMVESKVGQDSELENQDKKQEVKEAPPRELTEEEKQQILHSEEFLIFFDRTIRVIERALAEDSDIFFDYSGRELEEKDGDVQAGANLSFNRQFYDEHWSKHRVVTCMDWSLQYPELMVASYNNNEDAPHEPDGVALVWNMKFKKTTPEYVFHCQSSVMSVCFARFHPNLVVGGTYSGQIVLWDNRSHRRTPVQRTPLSAAAHTHPVYCVNVVGTQNAHNLITVSTDGKMCSWSLDMLSTPQESMELVYNKSKPVAVTGMAFPTGDVNNFVVGSEEGTVYTACRHGSKAGIGEVFEGHQGPVTGINCHMAVGPIDFSHLFVTSSFDWTVKLWTTKHNKPLYSFEDNADYVYDVMWSPVHPALFACVDGMGRLDLWNLNNDTEVPTASVAIEGASALNRVRWAQAGKEVAVGDSEGRIWVYDVGEGLAMLPGWSQNSWTQAILLCWPPKVLGLQT

SEQ ID NO: 26139 - protein, 612 aa, Homo sapiens
  Payload ID: 5170
  Gene Symbol: DYNC1I2
  Gene Name: dynein, cytoplasmic 1, intermediate chain 2
  Uniprot ID: Q13409
  ENSP ID: ENSP00000339430
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 26140 - protein, 638 aa, Homo sapiens
  Payload ID: 5170
  Gene Symbol: DYNC1I2
  Gene Name: dynein, cytoplasmic 1, intermediate chain 2
  Uniprot ID: Q13409
  ENSP ID: ENSP00000380308
MSDKSELKAELERKKQRLAQIREEKKRKEEERKKKETDQKKEAVAPVQEESDLEKKRREAEALLQSMGLTPESPIVFSEYWVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 26141 - protein, 612 aa, Homo sapiens; identical to SEQ ID NO: 26139
  Payload ID: 5170
  Gene Symbol: DYNC1I2
  Gene Name: dynein, cytoplasmic 1, intermediate chain 2
  Uniprot ID: Q13409
  ENSP ID: ENSP00000386397

SEQ ID NO: 26142 - protein, 638 aa, Homo sapiens; identical to SEQ ID NO: 26140
  Payload ID: 5170
  Gene Symbol: DYNC1I2
  Gene Name: dynein, cytoplasmic 1, intermediate chain 2
  Uniprot ID: Q13409
  ENSP ID: ENSP00000386415

SEQ ID NO: 26143 - protein, 630 aa, Homo sapiens
  Payload ID: 5170
  Gene Symbol: DYNC1I2
  Gene Name: dynein, cytoplasmic 1, intermediate chain 2
  Uniprot ID: Q13409
  ENSP ID: ENSP00000386522
MSDKSELKAELERKKQRLAQIREEKKRKEEERKKKETDQKKEAVAPVQEESDLEKKRREAEALLQSMGLTPESPIAEQPLRVVTADTCLFHYLVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 26144 - protein, 632 aa, Homo sapiens
  Payload ID: 5170
  Gene Symbol: DYNC1I2
  Gene Name: dynein, cytoplasmic 1, intermediate chain 2
  Uniprot ID: Q13409
  ENSP ID: ENSP00000386591
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 26145 - protein, 637 aa, Homo sapiens
  Payload ID: 5170
  Gene Symbol: DYNC1I2
  Gene Name: dynein, cytoplasmic 1, intermediate chain 2
  Uniprot ID: Q13409
  ENSP ID: ENSP00000386886
MSDKSELKAELERKKQRLAQIREEKKRKEEERKKKETDQKKEAVAPVQEESDLEKKRREAEALLQSMGLTPESPIVFSEYWVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEIAVPRNDEWARFGRTLAEINANRADAEEEAATRIPA

SEQ ID NO: 26146 - protein, 187 aa, Homo sapiens
  Payload ID: 5170
  Gene Symbol: DYNC1I2
  Gene Name: dynein, cytoplasmic 1, intermediate chain 2
  ENSP ID: ENSP00000388699
MSDKSELKAELERKKQRLAQIREEKKRKEEERKKKETDQKKEAVAPVQEESDLEKKRREAEALLQSMGLTPESPIAEQPLRVVTADTCLFHYLVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKK

SEQ ID NO: 26147 - protein, 214 aa, Homo sapiens
  Payload ID: 5170
  Gene Symbol: DYNC1I2
  Gene Name: dynein, cytoplasmic 1, intermediate chain 2
  ENSP ID: ENSP00000392741
MSDKSELKAELERKKQRLAQIREEKKRKEEERKKKETDQKKEAVAPVQEESDLEKKRREAEALLQSMGLTPESPIAEQPLRVVTADTCLFHYLVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSK

SEQ ID NO: 26148 - protein, 185 aa, Homo sapiens
  Payload ID: 5170
  Gene Symbol: DYNC1I2
  Gene Name: dynein, cytoplasmic 1, intermediate chain 2
  ENSP ID: ENSP00000394492
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEE

SEQ ID NO: 26149 - protein, 173 aa, Homo sapiens
  Payload ID: 5170
  Gene Symbol: DYNC1I2
  Gene Name: dynein, cytoplasmic 1, intermediate chain 2
  ENSP ID: ENSP00000397654
MSDKSELKAELERKKQRLAQIREEKKRKEEERKKKETDQKKEAVAPVQEESDLEKKRREAEALLQSMGLTPESPIAEQPLRVVTADTCLFHYLVPPPMSPSSKSVSTPSEAGSQDSGDGAVGSRRGPIKLGMAKITQVDFPPREIVTYTKETQTPVMAQPKEDEEEDDDVVAP

SEQ ID NO: 26150 - protein, 250 aa, Homo sapiens
  Payload ID: 5170
  Gene Symbol: DYNC1I2
  Gene Name: dynein, cytoplasmic 1, intermediate chain 2
  ENSP ID: ENSP00000398765
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKE

SEQ ID NO: 26151 - protein, 139 aa, Homo sapiens
  Payload ID: 5170
  Gene Symbol: DYNC1I2
  Gene Name: dynein, cytoplasmic 1, intermediate chain 2
  ENSP ID: ENSP00000401005
MSDKSELKAELERKKQRLAQIREEKKRKEEERKKKETDQKKEAVAPVQEESDLEKKRREAEALLQSMGLTPESPIVFSEYWVPPPMSPSSKSVSTPSEAGSQDSGDGAVGSRTLHWDTDPSVLQLHSDSDLGRGPIKLG

SEQ ID NO: 26152 - protein, 184 aa, Homo sapiens
  Payload ID: 5170
  Gene Symbol: DYNC1I2
  Gene Name: dynein, cytoplasmic 1, intermediate chain 2
  ENSP ID: ENSP00000403089
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEE

SEQ ID NO: 26153 - protein, 151 aa, Homo sapiens
  Payload ID: 5170
  Gene Symbol: DYNC1I2
  Gene Name: dynein, cytoplasmic 1, intermediate chain 2
  ENSP ID: ENSP00000405454
MSDKSELKAELERKKQRLAQIREEKKRKEEERKKKETDQKKEAVAPVQEESDLEKKRREAEALLQSMGLTPESPIAEQPLRVVTADTCLFHYLVPPPMSPSSKSVSTPSEAGSQDSGDGAVGSRTLHWDTDPSVLQLHSDSDLGRGPIKLG

SEQ ID NO: 26154 - protein, 137 aa, Homo sapiens
  Payload ID: 5170
  Gene Symbol: DYNC1I2
  Gene Name: dynein, cytoplasmic 1, intermediate chain 2
  ENSP ID: ENSP00000406104
MSDKSELKAELERKKQRLAQIREEKKRKEEERKKKETDQKKEAVAPVQEESDLEKKRREAEALLQSMGLTPESPIAEQPLRVVTADTCLFHYLVPPPMSPSSKSVSTPSEAGSQDSGDGAVGSRRGPIKLGMAKITQ

SEQ ID NO: 26155 - protein, 110 aa, Homo sapiens
  Payload ID: 5170
  Gene Symbol: DYNC1I2
  Gene Name: dynein, cytoplasmic 1, intermediate chain 2
  ENSP ID: ENSP00000409951
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRTLHW

SEQ ID NO: 26156 - protein, 305 aa, Homo sapiens
  Payload ID: 5170
  Gene Symbol: DYNC1I2
  Gene Name: dynein, cytoplasmic 1, intermediate chain 2
  ENSP ID: ENSP00000410807
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHC

SEQ ID NO: 26157 - protein, 121 aa, Homo sapiens
  Payload ID: 5170
  Gene Symbol: DYNC1I2
  Gene Name: dynein, cytoplasmic 1, intermediate chain 2
  ENSP ID: ENSP00000415410
MSDKSELKAELERKKQRLAQIREEKKRKEEERKKKETDQKKEAVAPVQEESDLEKKRREAEALLQSMGLTPESPIDEDLLNLEWLKSRKSTFLLEKLSRIQRKLRLQLWLNPKKMKRKMMM

SEQ ID NO: 26158 - protein, 611 aa, Homo sapiens
  Payload ID: 5170
  Gene Symbol: DYNC1I2
  Gene Name: dynein, cytoplasmic 1, intermediate chain 2
  Uniprot ID: Q13409
  ENSP ID: ENSP00000423339
MSDKSELKAELERKKQRLAQIREEKKRKEEERKKKETDQKKEAVAPVQEESDLEKKRREAEALLQSMGLTPESPIVPPPMSPSSKSVSTPSEAGSQDSGDGAVGSRRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEIAVPRNDEWARFGRTLAEINANRADAEEEAATRIPA

SEQ ID NO: 26159 - protein, 523 aa, Homo sapiens
  Payload ID: 5171
  Gene Symbol: DYNC1LI1
  Gene Name: dynein, cytoplasmic 1, light intermediate chain 1
  Uniprot ID: Q9Y6G9
  ENSP ID: ENSP00000273130
MAAVGRVGSFGSSPPGLSSTYTGGPLGNEIASGNGGAAAGDDEDGQNLWSCILSEVSTRSRSKLPAGKNVLLLGEDGAGKTSLIRKIQGIEEYKKGRGLEYLYLNVHDEDRDDQTRCNVWILDGDLYHKGLLKFSLDAVSLKDTLVMLVVDMSKPWTALDSLQKWASVVREHVDKLKIPPEEMKQMEQKLIRDFQEYVEPGEDFPASPQRRNTASQEDKDDSVVLPLGADTLTHNLGIPVLVVCTKCDAISVLEKEHDYRDEHFDFIQSHIRKFCLQYGAALIYTSVKENKNIDLVYKYIVQKLYGFPYKIPAVVVEKDAVFIPAGWDNDKKIGILHENFQTLKAEDNFEDIITKPPVRKFVHEKEIMAEDDQVFLMKLQSLLAKQPPTAAGRPVDASPRVPGGSPRTPNRSVSSNVASVSPIPAGSKKIDPNMKAGATSEGVLANFFNSLLSKKTGSPGGPGVSGGSPAGGAGGGSSGLPPSTKKSGQKPVLDVHAELDRITRKPVTVSPTTPTSPTEGEAS

SEQ ID NO: 26160 - protein, 190 aa, Homo sapiens
  Payload ID: 5171
  Gene Symbol: DYNC1LI1
  Gene Name: dynein, cytoplasmic 1, light intermediate chain 1
  ENSP ID: ENSP00000390507
MAGREGEHETLDPGPAGTRPPSGEDGAGKTSLIRKIQGIEEYKKGRGLEYLYLNVHDEDRDDQTRCNVWILDGDLYHKGLLKFSLDAVSLKDTLVMLVVDMSKPWTALDSLQKWASVVREHVDKLKIPPEEMKQMEQKLIRDFQEYVEPGEDFPASPQRRNTASQEDKDDSVVLPLGADTLTHNLGIPVL

SEQ ID NO: 26161 - protein, 407 aa, Homo sapiens
  Payload ID: 5171
  Gene Symbol: DYNC1LI1
  Gene Name: dynein, cytoplasmic 1, light intermediate chain 1
  ENSP ID: ENSP00000407279
MAAVGRVGSFGSSPPGLSSTYTGGPLGNEIASGNGGAAAGDDEDGQNLWSCILSEVSTRSRSKLPAGKNVLLLVIRDFQEYVEPGEDFPASPQRRNTASQEDKDDSVVLPLGADTLTHNLGIPVLVVCTKCDAISVLEKEHDYRDEHFDFIQSHIRKFCLQYGAALIYTSVKENKNIDLVYKYIVQKLYGFPYKIPAVVVEKDAVFIPAGWDNDKKIGILHENFQTLKAEDNFEDIITKPPVRKFVHEKEIMAEDDQVFLMKLQSLLAKQPPTAAGRPVDASPRVPGGSPRTPNRSVSSNVASVSPIPAGSKKIDPNMKAGATSEGVLANFFNSLLSKKTGSPGGPGVSGGSPAGGAGGGSSGLPPSTKKSGQKPVLDVHAELDRITRKPVTVSPTTPTSPTEGEAS

SEQ ID NO: 26162 - protein, 192 aa, Homo sapiens
  Payload ID: 5171
  Gene Symbol: DYNC1LI1
  Gene Name: dynein, cytoplasmic 1, light intermediate chain 1
  ENSP ID: ENSP00000409019
MAAVGRVGSFGSSPPGLSSTYTGGPLGNEIASGNGGAAAGDDEDGQNLWSCILSEVSTRSRSKLPAGKNVLLLDGVSLLLPRLECNGKISAHCNLHLLGSSDSPASASCVAGITGEDGAGKTSLIRKIQGIEEYKKGRGLEYLYLNVHDEDRDDQTRCNVWILDGDLYHKGLLKFSLDAVSLKDTLVMLVVD

SEQ ID NO: 26163 - protein, 492 aa, Homo sapiens
  Payload ID: 5172
  Gene Symbol: DYNC1LI2
  Gene Name: dynein, cytoplasmic 1, light intermediate chain 2
  Uniprot ID: O43237
  ENSP ID: ENSP00000258198
MAPVGVEKKLLLGPNGPAVAAAGDLTSEEEEGQSLWSSILSEVSTRARSKLPSGKNILVFGEDGSGKTTLMTKLQGAEHGKKGRGLEYLYLSVHDEDRDDHTRCNVWILDGDLYHKGLLKFAVSAESLPETLVIFVADMSRPWTVMESLQKWASVLREHIDKMKIPPEKMRELERKFVKDFQDYMEPEEGCQGSPQRRGPLTSGSDEENVALPLGDNVLTHNLGIPVLVVCTKCDAVSVLEKEHDYRDEHLDFIQSHLRRFCLQYGAALIYTSVKEEKNLDLLYKYIVHKTYGFHFTTPALVVEKDAVFIPAGWDNEKKIAILHENFTTVKPEDAYEDFIVKPPVRKLVHDKELAAEDEQVFLMKQQSLLAKQPATPTRASESPARGPSGSPRTQGRGGPASVPSSSPGTSVKKPDPNIKNNAASEGVLASFFNSLLSKKTGSPGSPGAGGVQSTAKKSGQKTVLSNVQEELDRMTRKPDSMVTNSSTENEA

SEQ ID NO: 26164 - protein, 415 aa, Homo sapiens
  Payload ID: 5172
  Gene Symbol: DYNC1LI2
  Gene Name: dynein, cytoplasmic 1, light intermediate chain 2
  Uniprot ID: O43237
  ENSP ID: ENSP00000394289
MAPVGVEKKLLLGPNGPAVAAAGDLTSEEEEGQSLWSSILSEVSTRARSKLPSGKNILVFGEDGSGKTTLMTKLQGAEHGKKGRGLEYLYLSVHDEDRDVVKDFQDYMEPEEGCQGSPQRRGPLTSGSDEENVALPLGDNVLTHNLGIPVLVVCTKCDAVSVLEKEHDYRDEHLDFIQSHLRRFCLQYGAALIYTSVKEEKNLDLLYKYIVHKTYGFHFTTPALVVEKDAVFIPAGWDNEKKIAILHENFTTVKPEDAYEDFIVKPPVRKLVHDKELAAEDEQVFLMKQQSLLAKQPATPTRASESPARGPSGSPRTQGRGGPASVPSSSPGTSVKKPDPNIKNNAASEGVLASFFNSLLSKKTGSPGSPGAGGVQSTAKKSGQKTVLSNVQEELDRMTRKPDSMVTNSSTENEA

SEQ ID NO: 26165 - protein, 271 aa, Homo sapiens
  Payload ID: 5172
  Gene Symbol: DYNC1LI2
  Gene Name: dynein, cytoplasmic 1, light intermediate chain 2
  ENSP ID: ENSP00000408566
MAPVGVEKKLLLGPNGPAVAAAGDLTSEEEEGQSLWSSILSEVSTRARSKLPSGKNILVFDHTRCNVWILDGDLYHKGLLKFAVSAESLPETLVIFVADMSRPWTVMESLQKWASVLREHIDKMKIPPEKMRELERKFVKDFQDYMEPEEGCQGSPQRRGPLTSGSDEENVALPLGDNVLTHNLGIPVLVVCTKCDAVSVLEKEHDYRDEHLDFIQSHLRRFCLQYGAALIYTSVKEEKNLDLLYKYIVHKTYGFHFTTPALVVEKDAVFM

SEQ ID NO: 26166 - protein, 56 aa, Homo sapiens
  Payload ID: 5172
  Gene Symbol: DYNC1LI2
  Gene Name: dynein, cytoplasmic 1, light intermediate chain 2
  ENSP ID: ENSP00000457464
MAPVGVEKKLLLGPNGPAVAAAGDLTSEEEEGQSLCCRPARTSWSSVKMVLVKQPS

SEQ ID NO: 26167 - protein, 186 aa, Homo sapiens
  Payload ID: 5172
  Gene Symbol: DYNC1LI2
  Gene Name: dynein, cytoplasmic 1, light intermediate chain 2
  ENSP ID: ENSP00000457707
MAPVGVEKKLLLGPNGPAVAAAGDLTSEEEEGQSLWSSILSEVSTRARSKLPSGKNILVFGEDGSGKTTLMTKLQGAEHGKKGRGLEYLYLSVHDEDRDDMSRPWTVMESLQKWASVLREHIDKMKIPPEKMRELERKFVKDFQDYMEPEEGCQGSPQRRGPLTSGSDEENVALPLGDNVLTHNLG

SEQ ID NO: 26168 - protein, 167 aa, Homo sapiens
  Payload ID: 5172
  Gene Symbol: DYNC1LI2
  Gene Name: dynein, cytoplasmic 1, light intermediate chain 2
  ENSP ID: ENSP00000462017
AGWDNEKKIAILHENFTTVKPEDAYEDFIVKPPVRKLVHDKELAAEDEQVFLMKQQESPARGPSGSPRTQGRGGPASVPSSSPGTSVKKPDPNIKNNAASEGVLASFFNSLLSKKTGSPGSPGAGGVQSTAKKSGQKTVLSNVQEELDRMTRKPDSMVTNSSTENEA

SEQ ID NO: 26169 - protein, 92 aa, Homo sapiens
  Payload ID: 5172
  Gene Symbol: DYNC1LI2
  Gene Name: dynein, cytoplasmic 1, light intermediate chain 2
  ENSP ID: ENSP00000462224
  MOD_RES (1)..(1): Any amino acid
XTPTRASESPARGPSGSPRTQGRGGPASVPSSSPGTSVKKPDPNIKNNAASEGVLASFFNSLLSKKTGSPGSPGAGGVQSTAKKSESRPPPP

SEQ ID NO: 26170 - protein, 49 aa, Homo sapiens
  Payload ID: 5172
  Gene Symbol: DYNC1LI2
  Gene Name: dynein, cytoplasmic 1, light intermediate chain 2
  ENSP ID: ENSP00000462434
LVHDKELAAEDEQVFLMKQQSLLAKQPATPTRASDKRLCCQMFRKNWIE

SEQ ID NO: 26171 - protein, 40 aa, Homo sapiens
  Payload ID: 5172
  Gene Symbol: DYNC1LI2
  Gene Name: dynein, cytoplasmic 1, light intermediate chain 2
  ENSP ID: ENSP00000463124
MAPVGVEKKLLLGPNGPAVAAAGDLTSEEEEGQSLCPARG

SEQ ID NO: 26172 - protein, 920 aa, Homo sapiens
  Payload ID: 5173
  Gene Symbol: DYNC2H1
  Gene Name: dynein, cytoplasmic 2, heavy chain 1
  Uniprot ID: Q8NCM8
  ENSP ID: ENSP00000334021
MANGTADVRKLFIFTTTQNYFGLMSELWDQPLLCNCLEINNFLDDGNQMLLRVQRSDAGISFSNTIEFGDTKDKVLVFFKLRPEVITDENLHDNILVSSMLESPISSLYQAVRQVFAPMLLKDQEWSRNFDPKLQNLLSELEAGLGIVLRRSDTNLTKLKFKEDDTRGILTPSDEFQFWIEQAHRGNKQISKERANYFKELFETIAREFYNLDSLSLLEVVDLVETTQDVVDDVWRQTEHDHYPESRMLHLLDIIGGSFGRFVQKKLGTLNLWEDPYYLVKESLKAGISICEQWVIVCNHLTGQVWQRYVPHPWKNEKYFPETLDKLGKRLEEVLAIRTIHEKFLYFLPASEEKIICLTRVFEPFTGLNPVQYNPYTEPLWKAAVSQYEKIIAPAEQKIAGKLKNYISEIQDSPQQLLQAFLKYKELVKRPTISKELMLERETLLARLVDSIKDFRLDFENRCRGIPGDASGPLSGKNLSEVVNSIVWVRQLELKVDDTIKIAEALLSDLPGFRCFHQSAKDLLDQLKLYEQEQFDDWSRDIQSGLSDSRSGLCIEASSRIMELDSNDGLLKVHYSDRLVILLREVRQLSALGFVIPAKIQQVANIAQKFCKQAIILKQVAHFYNSIDQQMIQSQRPMMLQSALAFEQIIKNSKAGSGGKSQITWDNPKELEGYIQKLQNAAERLATENRKLRKWHTTFCEKVVVLMNIDLLRQQQRWKDGLQELRTGLATVEAQCPLAWQSKWEGPEDPLQYLRGLVARALAIQNWVDKAEKQALLSETLDLSELFHPDTFLNALRQETARAVGRSVDSLKFVASWKGRLQEAKLQIKISGLLLEGCSFDGNQLSENQLDSPSVSSVLPCFMGWIPQDACGPYSPDECISLPVYTSAERDRVVTNIDVPCGGNQDQWIQCGAALFLKNQ

SEQ ID NO: 26173 - protein, 4307 aa, Homo sapiens
  Payload ID: 5173
  Gene Symbol: DYNC2H1
  Gene Name: dynein, cytoplasmic 2, heavy chain 1
  Uniprot ID: Q8NCM8
  ENSP ID: ENSP00000364887
MANGTADVRKLFIFTTTQNYFGLMSELWDQPLLCNCLEINNFLDDGNQMLLRVQRSDAGISFSNTIEFGDTKDKVLVFFKLRPEVITDENLHDNILVSSMLESPISSLYQAVRQVFAPMLLKDQEWSRNFDPKLQNLLSELEAGLGIVLRRSDTNLTKLKFKEDDTRGILTPSDEFQFWIEQAHRGNKQISKERANYFKELFETIAREFYNLDSLSLLEVVDLVETTQDVVDDVWRQTEHDHYPESRMLHLLDIIGGSFGRFVQKKLGTLNLWEDPYYLVKESLKAGISICEQWVIVCNHLTGQVWQRYVPHPWKNEKYFPETLDKLGKRLEEVLAIRTIHEKFLYFLPASEEKIICLTRVFEPFTGLNPVQYNPYTEPLWKAAVSQYEKIIAPAEQKIAGKLKNYISEIQDSPQQLLQAFLKYKELVKRPTISKELMLERETLLARLVDSIKDFRLDFENRCRGIPGDASGPLSGKNLSEVVNSIVWVRQLELKVDDTIKIAEALLSDLPGFRCFHQSAKDLLDQLKLYEQEQFDDWSRDIQSGLSDSRSGLCIEASSRIMELDSNDGLLKVHYSDRLVILLREVRQLSALGFVIPAKIQQVANIAQKFCKQAIILKQVAHFYNSIDQQMIQSQRPMMLQSALAFEQIIKNSKAGSGGKSQITWDNPKELEGYIQKLQNAAERLATENRKLRKWHTTFCEKVVVLMNIDLLRQQQRWKDGLQELRTGLATVEAQGFQASDMHAWKQHWNHQLYKALEHQYQMGLEALNENLPEINIDLTYKQGRLQFRPPFEEIRAKYYREMKRFIGIPNQFKGVGEAGDESIFSIMIDRNASGFLTIFSKAEDLFRRLSAVLHQHKEWIVIGQVDMEALVEKHLFTVHDWEKNFKALKIKGKEVERLPSAVKVDCLNINCNPVKTVIDDLIQKLFDLLVLSLKKSIQAHLHEIDTFVTEAMEVLTIMPQSVEEIGDANLQYSKLQERKPEILPLFQEAEDKNRLLRTVAGGGLETISNLKAKWDKFELMMESHQLMIKDQIEVMKGNVKSRLQIYYQELEKFKARWDQLKPGDDVIETGQHNTLDKSAKLIKEKKIEFDDLEVTRKKLVDDCHHFRLEEPNFSLASSISKDIESCAQIWAFYEEFQQGFQEMANEDWITFRTKTYLFEEFLMNWHDRLRKVEEHSVMTVKLQSEVDKYKIVIPILKYVRGEHLSPDHWLDLFRLLGLPRGTSLEKLLFGDLLRVADTIVAKAADLKDLNSRAQGEVTIREALRELDLWGVGAVFTLIDYEDSQSRTMKLIKDWKDIVNQVGDNRCLLQSLKDSPYYKGFEDKVSIWERKLAELDEYLQNLNHIQRKWVYLEPIFGRGALPKEQTRFNRVDEDFRSIMTDIKKDNRVTTLTTHAGIRNSLLTILDQLQRCQKSLNEFLEEKRSAFPRFYFIGDDDLLEILGQSTNPSVIQSHLKKLFAGINSVCFDEKSKHITAMKSLEGEVVPFKNKVPLSNNVETWLNDLALEMKKTLEQLLKECVTTGRSSQGAVDPSLFPSQILCLAEQIKFTEDVENAIKDHSLHQIETQLVNKLEQYTNIDTSSEDPGNTESGILELKLKALILDIIHNIDVVKQLNQIQVHTTEDWAWKKQLRFYMKSDHTCCVQMVDSEFQYTYEYQGNASKLVYTPLTDKCYLTLTQAMKMGLGGNPYGPAGTGKTESVKALGGLLGRQVLVFNCDEGIDVKSMGRIFVGLVKCGAWGCFDEFNRLEESVLSAVSMQIQTIQDALKNHRTVCELLGKEVEVNSNSGIFITMNPAGKGYGGRQKLPDNLKQLFRPVAMSHPDNELIAEVILYSEGFKDAKVLSRKLVAIFNLSRELLTPQQHYDWGLRALKTVLRGSGNLLRQLNKSGTTQNANESHIVVQALRLNTMSKFTFTDCTRFDALIKDVFPGIELKEVEYDELSAALKQVFEEANYEIIPNQIKKALELYEQLCQRMGVVIVGPSGAGKSTLWRMLRAALCKTGKVVKQYTMNPKAMPRYQLLGHIDMDTREWSDGVLTNSARQVVREPQDVSSWIICDGDIDPEWIESLNSVLDDNRLLTMPSGERIQFGPNVNFVFETHDLSCASPATISRMGMIFLSDEETDLNSLIKSWLRNQPAEYRNNLENWIGDYFEKALQWVLKQNDYVVETSLVGTVMNGLSHLHGCRDHDEFIINLIRGLGGNLNMKSRLEFTKEVFHWARESPPDFHKPMDTYYDSTRGRLATYVLKKPEDLTADDFSNGLTLPVIQTPDMQRGLDYFKPWLSSDTKQPFILVGPEGCGKGMLLRYAFSQLRSTQIATVHCSAQTTSRHLLQKLSQTCMVISTNTGRVYRPKDCERLVLYLKDINLPKLDKWGTSTLVAFLQQVLTYQGFYDENLEWVGLENIQIVASMSAGGRLGRHKLTTRFTSIVRLCSIDYPEREQLQTIYGAYLEPVLHKNLKNHSIWGSSSKIYLLAGSMVQVYEQVRAKFTVDDYSHYFFTPCILTQWVLGLFRYDLEGGSSNHPLDYVLEIVAYEARRLFRDKIVGAKELHLFDIILTSVFQGDWGSDILDNMSDSFYVTWGARHNSGARAAPGQPLPPHGKPLGKLNSTDLKDVIKKGLIHYGRDNQNLDILLFHEVLEYMSRIDRVLSFPGGSLLLAGRSGVGRRTITSLVSHMHGAVLFSPKISRGYELKQFKNDLKHVLQLAGIEAQQVVLLLEDYQFVHPTFLEMINSLLSSGEVPGLYTLEELEPLLLPLKDQASQDGFFGPVFNYFTYRIQQNLHIVLIMDSANSNFMINCESNPALHKKCQVLWMEGWSNSSMKKIPEMLFSETGGGEKYNDKKRKEEKKKNSVDPDFLKSFLLIHESCKAYGATPSRYMTFLHVYSAISSSKKKELLKRQSHLQAGVSKLNEAKALVDELNRKAGEQSVLLKTKQDEADAALQMITVSMQDASEQKTELERLKHRIAEEVVKIEERKNKIDDELKEVQPLVNEAKLAVGNIKPESLSEIRSLRMPPDVIRDILEGVLRLMGIFDTSWVSMKSFLAKRGVREDIATFDARNISKEIRESVEELLFKNKGSFDPKNAKRASTAAAPLAAWVKANIQYSHVLERIHPLETEQAGLESNLKKTEDRKRKLEELLNSVGQKVSELKEKFQSRTSEAAKLEAEVSKAQETIKAAEVLINQLDREHKRWNAQVVEITEELATLPKRAQLAAAFITYLSAAPESLRKTCLEEWTKSAGLEKFDLRRFLCTESEQLIWKSEGLPSDDLSIENALVILQSRVCPFLIDPSSQATEWLKTHLKDSRLEVINQQDSNFITALELAVRFGKTLIIQEMDGVEPVLYPLLRRDLVAQGPRYVVQIGDKIIDYNEEFRLFLSTRNPNPFIPPDAASIVTEVNFTTTRSGLRGQLLALTIQHEKPDLEEQKTKLLQQEEDKKIQLAKLEESLLETLATSQGNILENKDLIESLNQTKASSALIQESLKESYKLQISLDQERDAYLPLAESASKMYFIISDLSKINNMYRFSLAAFLRLFQRALQNKQDSENTEQRIQSLISSLQHMVYEYICRCLFKADQLMFALHFVRGMHPELFQENEWDTFTGVVVGDMLRKADSQQKIRDQLPSWIDQERSWAVATLKIALPSLYQTLCFEDAALWRTYYNNSMCEQEFPSILAKKVSLFQQILVVQALRPDRLQSAMALFACKTLGLKEVSPLPLNLKRLYKETLEIEPILIIISPGADPSQELQELANAERSGECYHQVAMGQGQADLAIQMLKECARNGDWLCLKNLHLVVSWLPVLEKELNTLQPKDTFRLWLTAEVHPNFTPILLQSSLKITYESPPGLKKNLMRTYESWTPEQISKKDNTHRAHALFSLAWFHAACQERRNYIPQGWTKFYEFSLSDLRAGYNIIDRLFDGAKDVQWEFVHGLLENAIYGGRIDNYFDLRVLQSYLKQFFNSSVIDVFNQRNKKSIFPYSVSLPQSCSILDYRAVIEKIPEDDKPSFFGLPANIARSSQRMISSQVISQLRILGRSITAGSKFDREIWSNELSPVLNLWKKLNQNSNLIHQKVPPPNDRQGSPILSFIILEQFNAIRLVQSVHQSLAALSKVIRGTTLLSSEVQKLASALLNQKCPLAWQSKWEGPEDPLQYLRGLVARALAIQNWVDKAEKQALLSETLDLSELFHPDTFLNALRQETARAVGRSVDSLKFVASWKGRLQEAKLQIKISGLLLEGCSFDGNQLSENQLDSPSVSSVLPCFMGWIPQDACGPYSPDECISLPVYTSAERDRVVTNIDVPCGGNQDQWIQCGAALFLKNQ

SEQ ID NO: 26174 - protein, 4314 aa, Homo sapiens
  Payload ID: 5173
  Gene Symbol: DYNC2H1
  Gene Name: dynein, cytoplasmic 2, heavy chain 1
  Uniprot ID: Q8NCM8
  ENSP ID: ENSP00000381167
MANGTADVRKLFIFTTTQNYFGLMSELWDQPLLCNCLEINNFLDDGNQMLLRVQRSDAGISFSNTIEFGDTKDKVLVFFKLRPEVITDENLHDNILVSSMLESPISSLYQAVRQVFAPMLLKDQEWSRNFDPKLQNLLSELEAGLGIVLRRSDTNLTKLKFKEDDTRGILTPSDEFQFWIEQAHRGNKQISKERANYFKELFETIAREFYNLDSLSLLEVVDLVETTQDVVDDVWRQTEHDHYPESRMLHLLDIIGGSFGRFVQKKLGTLNLWEDPYYLVKESLKAGISICEQWVIVCNHLTGQVWQRYVPHPWKNEKYFPETLDKLGKRLEEVLAIRTIHEKFLYFLPASEEKIICLTRVFEPFTGLNPVQYNPYTEPLWKAAVSQYEKIIAPAEQKIAGKLKNYISEIQDSPQQLLQAFLKYKELVKRPTISKELMLERETLLARLVDSIKDFRLDFENRCRGIPGDASGPLSGKNLSEVVNSIVWVRQLELKVDDTIKIAEALLSDLPGFRCFHQSAKDLLDQLKLYEQEQFDDWSRDIQSGLSDSRSGLCIEASSRIMELDSNDGLLKVHYSDRLVILLREVRQLSALGFVIPAKIQQVANIAQKFCKQAIILKQVAHFYNSIDQQMIQSQRPMMLQSALAFEQIIKNSKAGSGGKSQITWDNPKELEGYIQKLQNAAERLATENRKLRKWHTTFCEKVVVLMNIDLLRQQQRWKDGLQELRTGLATVEAQGFQASDMHAWKQHWNHQLYKALEHQYQMGLEALNENLPEINIDLTYKQGRLQFRPPFEEIRAKYYREMKRFIGIPNQFKGVGEAGDESIFSIMIDRNASGFLTIFSKAEDLFRRLSAVLHQHKEWIVIGQVDMEALVEKHLFTVHDWEKNFKALKIKGKEVERLPSAVKVDCLNINCNPVKTVIDDLIQKLFDLLVLSLKKSIQAHLHEIDTFVTEAMEVLTIMPQSVEEIGDANLQYSKLQERKPEILPLFQEAEDKNRLLRTVAGGGLETISNLKAKWDKFELMMESHQLMIKDQIEVMKGNVKSRLQIYYQELEKFKARWDQLKPGDDVIETGQHNTLDKSAKLIKEKKIEFDDLEVTRKKLVDDCHHFRLEEPNFSLASSISKDIESCAQIWAFYEEFQQGFQEMANEDWITFRTKTYLFEEFLMNWHDRLRKVEEHSVMTVKLQSEVDKYKIVIPILKYVRGEHLSPDHWLDLFRLLGLPRGTSLEKLLFGDLLRVADTIVAKAADLKDLNSRAQGEVTIREALRELDLWGVGAVFTLIDYEDSQSRTMKLIKDWKDIVNQVGDNRCLLQSLKDSPYYKGFEDKVSIWERKLAELDEYLQNLNHIQRKWVYLEPIFGRGALPKEQTRFNRVDEDFRSIMTDIKKDNRVTTLTTHAGIRNSLLTILDQLQRCQKSLNEFLEEKRSAFPRFYFIGDDDLLEILGQSTNPSVIQSHLKKLFAGINSVCFDEKSKHITAMKSLEGEVVPFKNKVPLSNNVETWLNDLALEMKKTLEQLLKECVTTGRSSQGAVDPSLFPSQILCLAEQIKFTEDVENAIKDHSLHQIETQLVNKLEQYTNIDTSSEDPGNTESGILELKLKALILDIIHNIDVVKQLNQIQVHTTEDWAWKKQLRFYMKSDHTCCVQMVDSEFQYTYEYQGNASKLVYTPLTDKCYLTLTQAMKMGLGGNPYGPAGTGKTESVKALGGLLGRQVLVFNCDEGIDVKSMGRIFVGLVKCGAWGCFDEFNRLEESVLSAVSMQIQTIQDALKNHRTVCELLGKEVEVNSNSGIFITMNPAGKGYGGRQKLPDNLKQLFRPVAMSHPDNELIAEVILYSEGFKDAKVLSRKLVAIFNLSRELLTPQQHYDWGLRALKTVLRGSGNLLRQLNKSGTTQNANESHIVVQALRLNTMSKFTFTDCTRFDALIKDVFPGIELKEVEYDELSAALKQVFEEANYEIIPNQIKKALELYEQLCQRMGVVIVGPSGAGKSTLWRMLRAALCKTGKVVKQYTMNPKAMPRYQLLGHIDMDTREWSDGVLTNSARQVVREPQDVSSWIICDGDIDPEWIESLNSVLDDNRLLTMPSGERIQFGPNVNFVFETHDLSCASPATISRMGMIFLSDEETDLNSLIKSWLRNQPAEYRNNLENWIGDYFEKALQWVLKQNDYVVETSLVGTVMNGLSHLHGCRDHDEFIINLIRGLGGNLNMKSRLEFTKEVFHWARESPPDFHKPMDTYYDSTRGRLATYVLKKPEDLTADDFSNGLTLPVIQTPDMQRGLDYFKPWLSSDTKQPFILVGPEGCGKGMLLRYAFSQLRSTQIATVHCSAQTTSRHLLQKLSQTCMVISTNTGRVYRPKDCERLVLYLKDINLPKLDKWGTSTLVAFLQQVLTYQGFYDENLEWVGLENIQIVASMSAGGRLGRHKLTTRFTSIVRLCSIDYPEREQLQTIYGAYLEPVLHKNLKNHSIWGSSSKIYLLAGSMVQVYEQVRAKFTVDDYSHYFFTPCILTQWVLGLFRYDLEGGSSNHPLDYVLEIVAYEARRLFRDKIVGAKELHLFDIILTSVFQGDWGSDILDNMSDSFYVTWGARHNSGARAAPGQPLPPHGKPLGKLNSTDLKDVIKKGLIHYGRDNQNLDILLFHEVLEYMSRIDRVLSFPGGSLLLAGRSGVGRRTITSLVSHMHGAVLFSPKISRGYELKQFKNDLKHVLQLAGIEAQQVVLLLEDYQFVHPTFLEMINSLLSSGEVPGLYTLEELEPLLLPLKDQASQDGFFGPVFNYFTYRIQQNLHIVLIMDSANSNFMINCESNPALHKKCQVLWMEGWSNSSMKKIPEMLFSETGGGEKYNDKKRKEEKKKNSVDPDFLKSFLLIHESCKAYGATPSRYMTFLHVYSAISSSKKKELLKRQSHLQAGVSKLNEAKALVDELNRKAGEQSVLLKTKQDEADAALQMITVSMQDASEQKTELERLKHRIAEEVVKIEERKNKIDDELKEVQPLVNEAKLAVGNIKPESLSEIRSLRMPPDVIRDILEGVLRLMGIFDTSWVSMKSFLAKRGVREDIATFDARNISKEIRESVEELLFKNKGSFDPKNAKRASTAAAPLAAWVKANIQYSHVLERIHPLETEQAGLESNLKKTEDRKRKLEELLNSVGQKVSELKEKFQSRTSEAAKLEAEVSKAQETIKAAEVLINQLDREHKRWNAQVVEITEELATLPKRAQLAAAFITYLSAAPESLRKTCLEEWTKSAGLEKFDLRRFLCTESEQLIWKSEGLPSDDLSIENALVILQIIGLKSWSRVCPFLIDPSSQATEWLKTHLKDSRLEVINQQDSNFITALELAVRFGKTLIIQEMDGVEPVLYPLLRRDLVAQGPRYVVQIGDKIIDYNEEFRLFLSTRNPNPFIPPDAASIVTEVNFTTTRSGLRGQLLALTIQHEKPDLEEQKTKLLQQEEDKKIQLAKLEESLLETLATSQGNILENKDLIESLNQTKASSALIQESLKESYKLQISLDQERDAYLPLAESASKMYFIISDLSKINNMYRFSLAAFLRLFQRALQNKQDSENTEQRIQSLISSLQHMVYEYICRCLFKADQLMFALHFVRGMHPELFQENEWDTFTGVVVGDMLRKADSQQKIRDQLPSWIDQERSWAVATLKIALPSLYQTLCFEDAALWRTYYNNSMCEQEFPSILAKKVSLFQQILVVQALRPDRLQSAMALFACKTLGLKEVSPLPLNLKRLYKETLEIEPILIIISPGADPSQELQELANAERSGECYHQVAMGQGQADLAIQMLKECARNGDWLCLKNLHLVVSWLPVLEKELNTLQPKDTFRLWLTAEVHPNFTPILLQSSLKITYESPPGLKKNLMRTYESWTPEQISKKDNTHRAHALFSLAWFHAACQERRNYIPQGWTKFYEFSLSDLRAGYNIIDRLFDGAKDVQWEFVHGLLENAIYGGRIDNYFDLRVLQSYLKQFFNSSVIDVFNQRNKKSIFPYSVSLPQSCSILDYRAVIEKIPEDDKPSFFGLPANIARSSQRMISSQVISQLRILGRSITAGSKFDREIWSNELSPVLNLWKKLNQNSNLIHQKVPPPNDRQGSPILSFIILEQFNAIRLVQSVHQSLAALSKVIRGTTLLSSEVQKLASALLNQKCPLAWQSKWEGPEDPLQYLRGLVARALAIQNWVDKAEKQALLSETLDLSELFHPDTFLNALRQETARAVGRSVDSLKFVASWKGRLQEAKLQIKISGLLLEGCSFDGNQLSENQLDSPSVSSVLPCFMGWIPQDACGPYSPDECISLPVYTSAERDRVVTNIDVPCGGNQDQWIQCGAALFLKNQ

SEQ ID NO: 26175 - protein, 378 aa, Homo sapiens
  Payload ID: 5173
  Gene Symbol: DYNC2H1
  Gene Name: dynein, cytoplasmic 2, heavy chain 1
  ENSP ID: ENSP00000433451
QKIRDQLPSWIDQERSWAVATLKIALPSLYQTLCFEDAALWRTYYNNSMCEQEFPSILAKKVSLFQQILVVQALRPDRLQSAMALFACKTLGLKEVSPLPLNLKRLYKETLEIEPILIIISPGADPSQELQELANAERSGECYHQVAMGQGQADLAIQMLKECARNGDWLCLKNLHLVVSWLPVLEKELNTLQPKDTFRLWLTAEVHPNFTPILLQSSLKITYESPPGLKKNLMRTYESWTPEQISKKDNTHRAHALFSLAWFHAACQERRNYIPQGWTKFYEFSLSDLRAGYNIIDRLFDGAKDVQWEFVHGLLENAIYGGRIDNYFDLRVLQSYLKQFFNSSVIDVFNQRNKKSIFPYSVSLPQSCSILVGLSCCH

SEQ ID NO: 26176 - protein, 224 aa, Homo sapiens
  Payload ID: 5173
  Gene Symbol: DYNC2H1
  Gene Name: dynein, cytoplasmic 2, heavy chain 1
  ENSP ID: ENSP00000436736
VISQLRILGRSITAGSKFDREIWSNELSPVLNLWKKLNQCPLAWQSKWEGPEDPLQYLRGLVARALAIQNWVDKAEKQALLSETLDLSELFHPDTFLNALRQETARAVGRSVDSLKFVASWKGRLQEAKLQIKISGLLLEGCSFDGNQLSENQLDSPSVSSVLPCFMGWIPQDACGPYSPDECISLPVYTSAERDRVVTNIDVPCGGNQDQWIQCGAALFLKNQ

SEQ ID NO: 26177 - protein, 351 aa, Homo sapiens
  Payload ID: 5174
  Gene Symbol: DYNC2LI1
  Gene Name: dynein, cytoplasmic 2, light intermediate chain 1
  Uniprot ID: Q8TCX1
  ENSP ID: ENSP00000260605
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLELEQYKRSSSKSWKQIELDS

SEQ ID NO: 26178 - protein, 318 aa, Homo sapiens
  Payload ID: 5174
  Gene Symbol: DYNC2LI1
  Gene Name: dynein, cytoplasmic 2, light intermediate chain 1
  ENSP ID: ENSP00000367850
  MOD_RES (1)..(1): Any amino acid
XGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLVLS

SEQ ID NO: 26179 - protein, 144 aa, Homo sapiens
  Payload ID: 5174
  Gene Symbol: DYNC2LI1
  Gene Name: dynein, cytoplasmic 2, light intermediate chain 1
  Uniprot ID: Q8TCX1
  ENSP ID: ENSP00000381804
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRSWQLSSLLPVSMNLTTPVPHINEIIHYLSFCYLFHLA

SEQ ID NO: 26180 - protein, 201 aa, Homo sapiens
  Payload ID: 5174
  Gene Symbol: DYNC2LI1
  Gene Name: dynein, cytoplasmic 2, light intermediate chain 1
  Uniprot ID: Q8TCX1
  ENSP ID: ENSP00000385738
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPVSCCLGLLLESLVPFIVNDNITNNFFRFLCMT

SEQ ID NO: 26181 - protein, 75 aa, Homo sapiens
  Payload ID: 5174
  Gene Symbol: DYNC2LI1
  Gene Name: dynein, cytoplasmic 2, light intermediate chain 1
  ENSP ID: ENSP00000428082
MPRQSLALLPRLECSGTILAQYNIHLLSSVKLSGKLQKLKWKKGELMEVKVMELKLQKNLFSSLAVKMGERLLLF

SEQ ID NO: 26182 - protein, 94 aa, Homo sapiens
  Payload ID: 5174
  Gene Symbol: DYNC2LI1
  Gene Name: dynein, cytoplasmic 2, light intermediate chain 1
  ENSP ID: ENSP00000430356
MPSETLWEIAKAEVEKRGINGSEGDGAEIAEKFVFFIGSKNGSLALSPRFECSGVISAHCSLCLLGSHHSPASASQVAGTAGAHDHAWERLLLF

SEQ ID NO: 26183 - protein, 72 aa, Homo sapiens
  Payload ID: 5174
  Gene Symbol: DYNC2LI1
  Gene Name: dynein, cytoplasmic 2, light intermediate chain 1
  ENSP ID: ENSP00000430525
MPSETLWEIAKAEVEKRGINGSEGDGAEIAEKFVFFIGSKNGGKTTIILRCLDSQKISLTFGNSVEEPLYWT

SEQ ID NO: 26184 - protein, 352 aa, Homo sapiens
  Payload ID: 5174
  Gene Symbol: DYNC2LI1
  Gene Name: dynein, cytoplasmic 2, light intermediate chain 1
  Uniprot ID: Q8TCX1
  ENSP ID: ENSP00000474032
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPQDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLELEQYKRSSSKSWKQIELDS

SEQ ID NO: 26185 - protein, 89 aa, Homo sapiens
  Payload ID: 5175
  Gene Symbol: DYNLL1
  Gene Name: dynein, light chain, LC8-type 1
  Uniprot ID: P63167
  ENSP ID: ENSP00000242577
MCDRKAVIKNADMSEEMQQDSVECATQALEKYNIEKDIAAHIKKEFDKKYNPTWHCIVGRNFGSYVTHETKHFIYFYLGQVAILLFKSG

SEQ ID NO: 26186 - protein, 89 aa, Homo sapiens; identical to SEQ ID NO: 26185
  Payload ID: 5175
  Gene Symbol: DYNLL1
  Gene Name: dynein, light chain, LC8-type 1
  Uniprot ID: P63167
  ENSP ID: ENSP00000376296

SEQ ID NO: 26187 - protein, 89 aa, Homo sapiens; identical to SEQ ID NO: 26185
  Payload ID: 5175
  Gene Symbol: DYNLL1
  Gene Name: dynein, light chain, LC8-type 1
  Uniprot ID: P63167
  ENSP ID: ENSP00000376297

SEQ ID NO: 26188 - protein, 67 aa, Homo sapiens
  Payload ID: 5175
  Gene Symbol: DYNLL1
  Gene Name: dynein, light chain, LC8-type 1
  ENSP ID: ENSP00000446596
MCDRKAVIKNADMSEEMQQDSVECATQALEKYNIEKDIAAHIKKVRMGAGADTQPGAGGSFPPILLS

SEQ ID NO: 26189 - protein, 89 aa, Homo sapiens; identical to SEQ ID NO: 26185
  Payload ID: 5175
  Gene Symbol: DYNLL1
  Gene Name: dynein, light chain, LC8-type 1
  Uniprot ID: P63167
  ENSP ID: ENSP00000446614

SEQ ID NO: 26190 - protein, 67 aa, Homo sapiens; identical to SEQ ID NO: 26188
  Payload ID: 5175
  Gene Symbol: DYNLL1
  Gene Name: dynein, light chain, LC8-type 1
  ENSP ID: ENSP00000447494

SEQ ID NO: 26191 - protein, 89 aa, Homo sapiens; identical to SEQ ID NO: 26185
  Payload ID: 5175
  Gene Symbol: DYNLL1
  Gene Name: dynein, light chain, LC8-type 1
  Uniprot ID: P63167
  ENSP ID: ENSP00000447907

SEQ ID NO: 26192 - protein, 67 aa, Homo sapiens; identical to SEQ ID NO: 26188
  Payload ID: 5175
  Gene Symbol: DYNLL1
  Gene Name: dynein, light chain, LC8-type 1
  ENSP ID: ENSP00000448608

SEQ ID NO: 26193 - protein, 42 aa, Homo sapiens
  Payload ID: 5175
  Gene Symbol: DYNLL1
  Gene Name: dynein, light chain, LC8-type 1
  ENSP ID: ENSP00000448834
MCDRKAVIKNADMSEEMQQDSVECATQALEKYNIEKDIAAHI

SEQ ID NO: 26194 - protein, 47 aa, Homo sapiens
  Payload ID: 5175
  Gene Symbol: DYNLL1
  Gene Name: dynein, light chain, LC8-type 1
  ENSP ID: ENSP00000449088
MCDRKAVIKNADMSEEMQQDSVECATQALEKYNIEKDIAAHIKKELR

SEQ ID NO: 26195 - protein, 89 aa, Homo sapiens
  Payload ID: 5176
  Gene Symbol: DYNLL2
  Gene Name: dynein, light chain, LC8-type 2
  Uniprot ID: Q96FJ2
  ENSP ID: ENSP00000477310
MSDRKAVIKNADMSEDMQQDAVDCATQAMEKYNIEKDIAAYIKKEFDKKYNPTWHCIVGRNFGSYVTHETKHFIYFYLGQVAILLFKSG

SEQ ID NO: 26196 - protein, 47 aa, Homo sapiens
  Payload ID: 5177
  Gene Symbol: DYNLRB1
  Gene Name: dynein, light chain, roadblock-type 1
  Uniprot ID: Q9NP97
  ENSP ID: ENSP00000300469
MAEVEETLKRLQSQKGVQGIIVVNTEGGWEPLGHCGDRSRPPAQGCP

SEQ ID NO: 26197 - protein, 96 aa, Homo sapiens
  Payload ID: 5177
  Gene Symbol: DYNLRB1
  Gene Name: dynein, light chain, roadblock-type 1
  Uniprot ID: Q9NP97
  ENSP ID: ENSP00000349679
MAEVEETLKRLQSQKGVQGIIVVNTEGIPIKSTMDNPTTTQYASLMHSFILKARSTVRDIDPQNDLTFLRIRSKKNEIMVAPDKDYFLIVIQNPTE

SEQ ID NO: 26198 - protein, 148 aa, Homo sapiens
  Payload ID: 5177
  Gene Symbol: DYNLRB1
  Gene Name: dynein, light chain, roadblock-type 1
  ENSP ID: ENSP00000363979
MGEGWAAALQPRVLGPWCAMATLATFPGSSVCGRLCQALYVSCISSASSQLCEAEVEETLKRLQSQKGVQGIIVVNTEGIPIKSTMDNPTTTQYASLMHSFILKARSTVRDIDPQNDLTFLRIRSKKNEIMVAPDKDYFLIVIQNPTE

SEQ ID NO: 26199 - protein, 96 aa, Homo sapiens
  Payload ID: 5178
  Gene Symbol: DYNLRB2
  Gene Name: dynein, light chain, roadblock-type 2
  Uniprot ID: Q8TF09
  ENSP ID: ENSP00000302936
MAEVEETLKRIQSHKGVIGTMVVNAEGIPIRTTLDNSTTVQYAGLLHHLTMKAKSTVRDIDPQNDLTFLRIRSKKHEIMVAPDKEYLLIVIQNPCE

SEQ ID NO: 26200 - protein, 54 aa, Homo sapiens
  Payload ID: 5178
  Gene Symbol: DYNLRB2
  Gene Name: dynein, light chain, roadblock-type 2
  ENSP ID: ENSP00000342009
MAEVEETLKRIQSHKGVIGTMVVNAEDPRFVTFKYARQLTAFQRKSGQQITIKD

SEQ ID NO: 26201 - protein, 40 aa, Homo sapiens
  Payload ID: 5178
  Gene Symbol: DYNLRB2
  Gene Name: dynein, light chain, roadblock-type 2
  ENSP ID: ENSP00000454846
MAEVEETLKRIQSHKGVIGTMVVNAEDKEYLLIVIQNPCE

SEQ ID NO: 26202 - protein, 44 aa, Homo sapiens
  Payload ID: 5178
  Gene Symbol: DYNLRB2
  Gene Name: dynein, light chain, roadblock-type 2
  ENSP ID: ENSP00000455216
MAEVEETLKRIQSHKGVIGTMVVNAEGKKTNTMSQSKNFRADSL

SEQ ID NO: 26203 - protein, 125 aa, Homo sapiens
  Payload ID: 5178
  Gene Symbol: DYNLRB2
  Gene Name: dynein, light chain, roadblock-type 2
  ENSP ID: ENSP00000455791
MNEWTNTGREPDPLPSSLPGPTAPGLGEPQAEVEETLKRIQSHKGVIGTMVVNAEGIPIRTTLDNSTTVQYAGLLHHLTMKAKSTVRDIDPQNDLTFLRIRSKKHEIMVAPDKEYLLIVIQNPCE

SEQ ID NO: 26204 - protein, 92 aa, Homo sapiens
  Payload ID: 5179
  Gene Symbol: DYNLT1
  Gene Name: dynein, light chain, Tctex-type 1
  ENSP ID: ENSP00000356052
MEDYQAAEETAFVVDEVSNIVKEAIESAIGGNAYQHSKVNQWTTNVVEQTLSQLTKLGKPFKYIGNGVLFLLYLRDGFLTLIRGASSTRNNS

SEQ ID NO: 26205 - protein, 67 aa, Homo sapiens [sequence omitted]

SEQ ID NO: 26206 - protein, 113 aa, Homo sapiens
  Payload ID: 5179
  Gene Symbol: DYNLT1
  Gene Name: dynein, light chain, Tctex-type 1
  Uniprot ID: P63172
  ENSP ID: ENSP00000356056
MEDYQAAEETAFVVDEVSNIVKEAIESAIGGNAYQHSKVNQWTTNVVEQTLSQLTKLGKPFKYIVTCVIMQKNGAGLHTASSCFWDSSTDGSCTVRWENKTMYCIVSAFGLSI

SEQ ID NO: 26207 - protein, 116 aa, Homo sapiens
  Payload ID: 5180
  Gene Symbol: DYNLT3
  Gene Name: dynein, light chain, Tctex-type 3
  Uniprot ID: P51808
  ENSP ID: ENSP00000367841
MEEYHRHCDEVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCIVNVFAIAIVL

SEQ ID NO: 26208 - protein, 152 aa, Homo sapiens
  Payload ID: 5180
  Gene Symbol: DYNLT3
  Gene Name: dynein, light chain, Tctex-type 3
  ENSP ID: ENSP00000367844
MEEYHRHCDEVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCGVLLCRPGWSAVMQFRLTATSASQVQVILLPQPPEYLELQAHAITPG

SEQ ID NO: 26209 - protein, 122 aa, Homo sapiens
  Payload ID: 5180
  Gene Symbol: DYNLT3
  Gene Name: dynein, light chain, Tctex-type 3
  ENSP ID: ENSP00000402695
MARSLGVLVALPFPLPVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCIVNVFAIAIVL

SEQ ID NO: 26210 - protein, 158 aa, Homo sapiens
  Payload ID: 5181
  Gene Symbol: DBNDD1
  Gene Name: dysbindin (dystrobrevin binding protein 1) domain containing 1
  Uniprot ID: Q9H9R9
  ENSP ID: ENSP00000002501
MEPPEGAGTGEIVKEAEVPQAALGVPAQGTGDNGHTPVEEEVGGIPVPAPGLLQVTERRQPLSSVSSLEVHFDLLDLTELTDMSDQELAEVFADSDDENLNTESPAGLHPLPRAGYLRSPSWTRTRAEQSHEKQPLGDPERQATVLDTFLTVERPQED

SEQ ID NO: 26211 - protein, 178 aa, Homo sapiens
  Payload ID: 5181
  Gene Symbol: DBNDD1
  Gene Name: dysbindin (dystrobrevin binding protein 1) domain containing 1
  Uniprot ID: Q9H9R9
  ENSP ID: ENSP00000306407
MGETWKNICSTVRHGWWLRDHRMAGLPIPPEIVKEAEVPQAALGVPAQGTGDNGHTPVEEEVGGIPVPAPGLLQVTERRQPLSSVSSLEVHFDLLDLTELTDMSDQELAEVFADSDDENLNTESPAGLHPLPRAGYLRSPSWTRTRAEQSHEKQPLGDPERQATVLDTFLTVERPQED

SEQ ID NO: 26212 - protein, 164 aa, Homo sapiens
  Payload ID: 5181
  Gene Symbol: DBNDD1
  Gene Name: dysbindin (dystrobrevin binding protein 1) domain containing 1
  ENSP ID: ENSP00000376699
MWEPCGSQGDTVSLDAEIVKEAEVPQAALGVPAQGTGDNGHTPVEEEVGGIPVPAPGLLQVTERRQPLSSVSSLEVHFDLLDLTELTDMSDQELAEVFADSDDENLNTESPAGLHPLPRAGYLRSPSWTRTRAEQSHEKQPLGDPERQATVLDTFLTVERPQED

SEQ ID NO: 26213 - protein, 79 aa, Homo sapiens
  Payload ID: 5181
  Gene Symbol: DBNDD1
  Gene Name: dysbindin (dystrobrevin binding protein 1) domain containing 1
  ENSP ID: ENSP00000456573
  MOD_RES (1)..(1): Any amino acid
XPGRSVSLSLPSASQAPPVPLASPEGRPHTVGAPHASTWKRTRGRQRARPPNASGKVETRFRESPVQPAQPPGLKRAMP

SEQ ID NO: 26214 - protein, 278 aa, Homo sapiens
  Payload ID: 5181
  Gene Symbol: DBNDD1
  Gene Name: dysbindin (dystrobrevin binding protein 1) domain containing 1
  Uniprot ID: Q9H9R9
  ENSP ID: ENSP00000457625
MTQQWREVNEDREAVAQARSWQSLNLGDRDMGVSFIETALALSAARARRPLLTSHPPSRPFQPPKHTPSPPPAPRVNSRHPGRSVSLSLPSASQAPPVPLASPEGRPHTVGAPHASTWKRTRGRQRARPPKIVKEAEVPQAALGVPAQGTGDNGHTPVEEEVGGIPVPAPGLLQVTERRQPLSSVSSLEVHFDLLDLTELTDMSDQELAEVFADSDDENLNTESPAGLHPLPRAGYLRSPSWTRTRAEQSHEKQPLGDPERQATVLDTFLTVERPQED

SEQ ID NO: 26215 - protein, 161 aa, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENSP ID: ENSP00000349822
MDPNPRAALERQQLRLRERQKFFEDILQPETEFVFPLSHLHLESQRPPIGSISSMEVNVDTLEQVELIDLGDPDAADVFLPCEDPPPTPQSSGMDNHLEELSLPVPTSDRTTSRTSSSSSSDSSTNLHSPNPSDDGADTPLAQSDEEEERGDGGAEPGACS

SEQ ID NO: 26216 - protein, 161 aa, Homo sapiens; identical to SEQ ID NO: 26215
  Payload ID: 5182
  Gene Symbol: DBNDD2
  Gene Name: dysbindin (dystrobrevin binding protein 1) domain containing 2
  Uniprot ID: Q9BQY9
  ENSP ID: ENSP00000354250

SEQ ID NO: 26217 - protein, 263 aa, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENSP ID: ENSP00000361795
MESWALAVFPEYRVSLLWCLELASPLWSLGQAPPLHETWFVGHTWFQGRGKRSPRAEVSRPEPGAPLLGCWLQWGAPSPGPLCLLFRLCSCTCFAPLPAGADMDPNPRAALERQQLRLRERQKFFEDILQPETEFVFPLSHLHLESQRPPIGSISSMEVNVDTLEQVELIDLGDPDAADVFLPCEDPPPTPQSSGMDNHLEELSLPVPTSDRTTSRTSSSSSSDSSTNLHSPNPSDDGADTPLAQSDEEEERGDGGAEPGACS

SEQ ID NO: 26218 - protein, 161 aa, Homo sapiens; identical to SEQ ID NO: 26215
  Payload ID: 5182
  Gene Symbol: DBNDD2
  Gene Name: dysbindin (dystrobrevin binding protein 1) domain containing 2
  Uniprot ID: Q9BQY9
  ENSP ID: ENSP00000361797

SEQ ID NO: 26219 - protein, 112 aa, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENSP ID: ENSP00000361802
MDPNPRAALERQQLRLRERQKFFEDILQPETEFVFPLSHLHLESQRPPIGSISSMEVNVDTLEQVELIDLGDPDAADVFLPCEDPPPTPQSSGMPLCFGDFSASQPEPDVRL

SEQ ID NO: 26220 - protein, 259 aa, Homo sapiens
  Payload ID: 5182
  Gene Symbol: DBNDD2
  Gene Name: dysbindin (dystrobrevin binding protein 1) domain containing 2
  Uniprot ID: Q9BQY9
  ENSP ID: ENSP00000361805
MGAGNFLTALEVPVAALAGAASDRRASCERVSPPPPLPHFRLPPLPRSRLPGPVSRPEPGAPLLGCWLQWGAPSPGPLCLLFRLCSCTCFAPLPAGADMDPNPRAALERQQLRLRERQKFFEDILQPETEFVFPLSHLHLESQRPPIGSISSMEVNVDTLEQVELIDLGDPDAADVFLPCEDPPPTPQSSGMDNHLEELSLPVPTSDRTTSRTSSSSSSDSSTNLHSPNPSDDGADTPLAQSDEEEERGDGGAEPGACS

SEQ ID NO: 26221 - protein, 112 aa, Homo sapiens; identical to SEQ ID NO: 26219
  Payload ID: 5182
  Gene Symbol: DBNDD2
  Gene Name: dysbindin (dystrobrevin binding protein 1) domain containing 2
  Uniprot ID: Q9BQY9
  ENSP ID: ENSP00000361807

SEQ ID NO: 26222 - protein, 161 aa, Homo sapiens; identical to SEQ ID NO: 26215
  Payload ID: 5182
  Gene Symbol: DBNDD2
  Gene Name: dysbindin (dystrobrevin binding protein 1) domain containing 2
  Uniprot ID: Q9BQY9
  ENSP ID: ENSP00000361808

SEQ ID NO: 26223 - protein, 172 aa, Homo sapiens
  Payload ID: 5182
  Gene Symbol: DBNDD2
  Gene Name: dysbindin (dystrobrevin binding protein 1) domain containing 2
  ENSP ID: ENSP00000414161
  MOD_RES (1)..(1): Any amino acid
XTWFQGRGKRSPRAEVSRPEPGAPLLGCWLQWGAPSPGPLCLLFRLCSCTCFAPLPAGADMDPNPRAALERQQLRLRERQKFFEDILQPETEFVFPLSHLHLESQRPPIGSISSMEVNVDTLEQVELIDLGDPDAADVFLPCEDPPPTPQSSGMPLCFGDFSASQPEPDVRL

SEQ ID NO: 26224 - protein, 2080 aa, Homo sapiens
  Payload ID: 5183
  Gene Symbol: DYSF
  Gene Name: dysferlin
  Uniprot ID: O75923
  ENSP ID: ENSP00000258104
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 26225 - protein, 2081 aa, Homo sapiens
  Payload ID: 5183
  Gene Symbol: DYSF
  Gene Name: dysferlin
  Uniprot ID: O75923
  ENSP ID: ENSP00000377678
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 26226 - protein, 2088 aa, Homo sapiens
  Payload ID: 5183
  Gene Symbol: DYSF
  Gene Name: dysferlin
  Uniprot ID: O75923
  ENSP ID: ENSP00000386285
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 26227 - protein, 2102 aa, Homo sapiens
  Payload ID: 5183
  Gene Symbol: DYSF
  Gene Name: dysferlin
  Uniprot ID: O75923
  ENSP ID: ENSP00000386512
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 26228 - protein, 2118 aa, Homo sapiens
  Payload ID: 5183
  Gene Symbol: DYSF
  Gene Name: dysferlin
  Uniprot ID: O75923
  ENSP ID: ENSP00000386547
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 26229 - protein, 2098 aa, Homo sapiens
  Payload ID: 5183
  Gene Symbol: DYSF
  Gene Name: dysferlin
  Uniprot ID: O75923
  ENSP ID: ENSP00000386617
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 26230 - protein, 2112 aa, Homo sapiens
  Payload ID: 5183
  Gene Symbol: DYSF
  Gene Name: dysferlin
  Uniprot ID: O75923
  ENSP ID: ENSP00000386683
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 26231 - protein, 2119 aa, Homo sapiens
  Payload ID: 5183
  Gene Symbol: DYSF
  Gene Name: dysferlin
  Uniprot ID: O75923
  ENSP ID: ENSP00000386881
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 26232 - protein, 2097 aa, Homo sapiens
  Payload ID: 5183
  Gene Symbol: DYSF
  Gene Name: dysferlin
  Uniprot ID: O75923
  ENSP ID: ENSP00000387137
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 26233 - protein, 2101 aa, Homo sapiens
  Payload ID: 5183
  Gene Symbol: DYSF
  Gene Name: dysferlin
  Uniprot ID: O75923
  ENSP ID: ENSP00000398305
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 26234 - protein, 2111 aa, Homo sapiens
  Payload ID: 5183
  Gene Symbol: DYSF
  Gene Name: dysferlin
  Uniprot ID: O75923
  ENSP ID: ENSP00000407046
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 26235 - protein, 514 aa, Homo sapiens
  Payload ID: 5184
  Gene Symbol: DKC1
  Gene Name: dyskeratosis congenita 1, dyskerin
  Uniprot ID: O60832
  ENSP ID: ENSP00000358563
MADAEVIILPKKHKKKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGLLLGVGGQMQELRRVRSGVMSEKDHMVTMHDVLDAQWLYDNHKDESYLRRVVYPLEKLLTSHKRLVMKDSAVNAICYGAKIMLPGVLRYEDGIEVNQEIVVITTKGEAICMAIALMTTAVISTCDHGIVAKIKRVIMERDTYPRKWGLGPKASQKKLMIKQGLLDKHGKPTDSTPATWKQEYVDYSESAKKEVVAEVVKAPQVVAEAAKTAKRKRESESESDETPPAAPQLIKKEKKKSKKDKKAKAGLESGAEPGDGDSDTTKKKKKKKKAKEVELVSE

SEQ ID NO: 26236 - protein, 76 aa, Homo sapiens
  Payload ID: 5184
  Gene Symbol: DKC1
  Gene Name: dyskeratosis congenita 1, dyskerin
  ENSP ID: ENSP00000389304
  MOD_RES (1)..(1): Any amino acid
XVRLHNAIEGGTQLSRALETLTGALFQRPPLIAAVKRQLRVRTIYESKMIEYDPERRLGKCHLLWGQDYASRCSSI

SEQ ID NO: 26237 - protein, 229 aa, Homo sapiens
  Payload ID: 5184
  Gene Symbol: DKC1
  Gene Name: dyskeratosis congenita 1, dyskerin
  ENSP ID: ENSP00000395693
  MOD_RES (1)..(1): Any amino acid
XKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGAAFLLCVCILGIFWVSCEAGTYIRTLCVH

SEQ ID NO: 26238 - protein, 258 aa, Homo sapiens
  Payload ID: 5184
  Gene Symbol: DKC1
  Gene Name: dyskeratosis congenita 1, dyskerin
  ENSP ID: ENSP00000400542
MADAEVIILPKKHKKKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWDHMVTMHDVLDAQWLYDNHKDESYLRRVVYPLEKLLTSHKR

SEQ ID NO: 26239 - protein, 207 aa, Homo sapiens
  Payload ID: 5184
  Gene Symbol: DKC1
  Gene Name: dyskeratosis congenita 1, dyskerin
  ENSP ID: ENSP00000407253
  MOD_RES (1)..(1): Any amino acid
XIFWVSCEAGTYIRTLCVHLGLLLGVGGQMQELRRVRSGVMSEKDHMVTMHDVLDAQWLYDNHKDESYLRRVVYPLEKLLTSHKRLVMKDSAVNAICYGAKIMLPGVLRYEDGIEVNQEIVVITTKGEAICMAIALMTTAVISTCDHGIVAKIKRVIMERDTYPRKWGLGPKASQKKLMIKQGLLDKHGKPTDSTPATWKQEYVDYR

SEQ ID NO: 26240 - protein, 169 aa, Homo sapiens
  Payload ID: 5184
  Gene Symbol: DKC1
  Gene Name: dyskeratosis congenita 1, dyskerin
  ENSP ID: ENSP00000407325
KKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGPRNSDRCLIPATPTYCCSKEAAPSEDHLREQND

SEQ ID NO: 26241 - protein, 420 aa, Homo sapiens
  Payload ID: 5184
  Gene Symbol: DKC1
  Gene Name: dyskeratosis congenita 1, dyskerin
  Uniprot ID: O60832
  ENSP ID: ENSP00000478387
MADAEVIILPKKHKKKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGLLLGVGGQMQELRRVRSGVMSEKDHMVTMHDVLDAQWLYDNHKDESYLRRVVYPLEKLLTSHKRLVMKDSAVNAICYGAKIMLPGVLRYEDGIEVNQEIVVITTKGEAICMAIALMTTAVISTCDHGIVAKIKRVIMERDTYPRKWGLGPKASQKKLMIKQGLLDKHGKPTDSTPATWKQEYVDYR

SEQ ID NO: 26242 - protein, 420 aa, Homo sapiens
  Payload ID: 5185
  Gene Symbol: DYX1C1
  Gene Name: dyslexia susceptibility 1 candidate 1
  Uniprot ID: Q8WXU2
  ENSP ID: ENSP00000299561
MPLQVSDYSWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKIEEEERKKIEDMKENERIKATKALEAWKEYQRKAEEQKKIQREEKLCQKEKQIKEERKKIKYKSLTRNLASRNLAPKGRNSENIFTEKLKEDSIPAPRSVGSIKINFTPRVFPTALRESQVAEEEEWLHKQAEARRAMNTDIAELCDLKEEEKNPEWLKDKGNKLFATENYLAAINAYNLAIRLNNKMPLLYLNRAACHLKLKNLHKAIEDSSKALELLMPPVTDNANARMKAHVRRGTAFCQLELYVEGLQDYEAALKIDPSNKIVQIDAEKIRNVIQGTELKS

SEQ ID NO: 26243 - protein, 420 aa, Homo sapiens; identical to SEQ ID NO: 26242
  Payload ID: 5185
  Gene Symbol: DYX1C1
  Gene Name: dyslexia susceptibility 1 candidate 1
  Uniprot ID: Q8WXU2
  ENSP ID: ENSP00000323275

SEQ ID NO: 26244 - protein, 376 aa, Homo sapiens
  Payload ID: 5185
  Gene Symbol: DYX1C1
  Gene Name: dyslexia susceptibility 1 candidate 1
  Uniprot ID: Q8WXU2
  ENSP ID: ENSP00000402640
MPLQVSDYSWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKIEEEERKKIEDMKENERIKATKALEAWKEYQRKAEEQKKIQREEKLCQKEKQIKEERKKIKYKSLTRNLASRNLAPKGRNSENIFTEKLKEDSIPAPRSVGSIKINFTPRVFPTALRESQVAEEEEWLHKQAEARRAMNTDIAELCDLKEEEKNPEWLKDKGNKLFATENYLAAINAYNLAIRLNNKMPLLYLNRAACHLKLKNLHKAIEDSSKAYRIMKRHLRLIHPTKLYKLMLRRFGM

SEQ ID NO: 26245 - protein, 381 aa, Homo sapiens
  Payload ID: 5185
  Gene Symbol: DYX1C1
  Gene Name: dyslexia susceptibility 1 candidate 1
  Uniprot ID: Q8WXU2
  ENSP ID: ENSP00000403412
MPLQVSDYSWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKIEEEERKKIEDMKENERIKATKALEAWKEYQRKAEEQKKIQREEKLCQKEKQIKEERKKIKYKSLTRNLASRNLAPKGRNSENIFTEKLKEDSIPAPRSVGSIKINFTPRVFPTALRESQVAEEEEWLHKQAEARRAMNTDIAELCDLKEEEKNPEWLKDKGNKLFATENYLAAINAYNLAIRLNNKMPLLYLNRAACHLKLKNLHKAIEDSSKEFCSLEGIECQASEPKLSHHIPSDLHVYIQMA

SEQ ID NO: 26246 - protein, 146 aa, Homo sapiens
  Payload ID: 5185
  Gene Symbol: DYX1C1
  Gene Name: dyslexia susceptibility 1 candidate 1
  ENSP ID: ENSP00000428097
MPLQVSDYSWQQTKTAVFLSLPLKGVCVRDTDVFCTENYLKVNFPPFLFEAFLYAPIDDESSKAKIGNDTIVFTLYKKEAAMWETLSVTGVDKEMMQRIREKSILQAQERAKEATEAKAAAKREDQKYALSVMMKGEIQKIYLLRS

SEQ ID NO: 26247 - protein, 71 aa, Homo sapiens
  Payload ID: 5185
  Gene Symbol: DYX1C1
  Gene Name: dyslexia susceptibility 1 candidate 1
  ENSP ID: ENSP00000429219
MPLQVSDYSWQQTKTAVFLSLPLKGVCVRDTDVFCTENYLKTMRAAKQRLGMTPLSSPCIKKKRPCGRPFL

SEQ ID NO: 26248 - protein, 5171 aa, Homo sapiens
  Payload ID: 5186
  Gene Symbol: DST
  Gene Name: dystonin
  Uniprot ID: Q03001
  ENSP ID: ENSP00000244364
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 26249 - protein, 5537 aa, Homo sapiens
  Payload ID: 5186
  Gene Symbol: DST
  Gene Name: dystonin
  ENSP ID: ENSP00000307959
MSSGNASYRCSMSSSADFSDEDDFSQKSGSASPAPGDTLPWNLPKHERSKRKIQGGSVLDPAERAVLRIADERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 26250 - protein, 7461 aa, Homo sapiens
  Payload ID: 5186
  Gene Symbol: DST
  Gene Name: dystonin
  ENSP ID: ENSP00000354508
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQFSSELQQCLQHTEKMHEYLTLLQDMKPPLDNQESLDNNLEALKNQLRQLETFELGLAPIAVILRKDMKLAEEFLKSLPSDFPRGHVEELSISHQSLKTAFSSLSNVSSERTKQIMLAIDSEMSKLAVSHEEFLHKLKSFSDWVSEKSKSVKDIEIVNVQDSEYVKKRLEFLKNVLKDLGHTKMQLETTAFDVQFFISEYAQDLSPNQSKQLLRLLNTTQKCFLDVQESVTTQVERLETQLHLEQDLDDQKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 26251 - protein, 5675 aa, Homo sapiens
  Payload ID: 5186
  Gene Symbol: DST
  Gene Name: dystonin
  ENSP ID: ENSP00000359790
MIAAAFLVLLRPYSIQCALFLLLLLLGTIATIVFFCCWHRKLQKGRHPMKSVFSGRSRSRDAVLRSHHFRSEGFRASPRHLRRRVAAAAAARLEEVKPVVEVHHQSEQETSVRKRRIKKSSRVQPEFYHSVQGASIRRPSSGNASYRCSMSSSADFSDEDDFSQKSGSASPAPGDTLPWNLPKHERSKRKIQGGSVLDPAERAVLRIADERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 26252 - protein, 2649 aa, Homo sapiens
  Payload ID: 5186
  Gene Symbol: DST
  Gene Name: dystonin
  Uniprot ID: Q03001
  ENSP ID: ENSP00000359801
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 26253 - protein, 5375 aa, Homo sapiens
  Payload ID: 5186
  Gene Symbol: DST
  Gene Name: dystonin
  ENSP ID: ENSP00000359824
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 26254 - protein, 689 aa, Homo sapiens
  Payload ID: 5186
  Gene Symbol: DST
  Gene Name: dystonin
  ENSP ID: ENSP00000393082
MIAAAFLVLLRPYSIQCALFLLLLLLGTIATIVFFCCWHRKLQKGRHPMKSVFSGRSRSRDAVLRSHHFRSEGFRASPRHLRRRVAAAAAARLEEVKPVVEVHHQSEQETSVRKRRIKKSSRVQPEFYHSVQGASIRRPSSGNASYRCSMSSSADFSDEDDFSQKSGSASPAPGDTLPWNLPKHERSKRKIQGGSVLDPAERAVLRIADERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFA

SEQ ID NO: 26255 - protein, 5497 aa, Homo sapiens
  Payload ID: 5186
  Gene Symbol: DST
  Gene Name: dystonin
  ENSP ID: ENSP00000400883
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 26256 - protein, 3060 aa, Homo sapiens
  Payload ID: 5186
  Gene Symbol: DST
  Gene Name: dystonin
  Uniprot ID: Q03001
  ENSP ID: ENSP00000404924
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQ

SEQ ID NO: 26257 - protein, 177 aa, Homo sapiens
  Payload ID: 5186
  Gene Symbol: DST
  Gene Name: dystonin
  ENSP ID: ENSP00000428068
  MOD_RES (1)..(1): Any amino acid
XQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIAKNKQYDMHTEVTTLKQEKNPVPSAEEWMLEGCRASGGLKKGDFLKKGLEPETFQNFDGDHACSVRDDEFKF

SEQ ID NO: 26258 - protein, 133 aa, Homo sapiens
  Payload ID: 5186
  Gene Symbol: DST
  Gene Name: dystonin
  ENSP ID: ENSP00000429075
MKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRD

SEQ ID NO: 26259 - protein, 154 aa, Homo sapiens
  Payload ID: 5186
  Gene Symbol: DST
  Gene Name: dystonin
  ENSP ID: ENSP00000429221
MMGQLMKNDQDWNAKLVGLMCCMDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWT

SEQ ID NO: 26260 - protein, 123 aa, Homo sapiens
  Payload ID: 5186
  Gene Symbol: DST
  Gene Name: dystonin
  ENSP ID: ENSP00000430472
EMTRKQPDVDKVTKTYKRRAADPSSLQSHIPVLDKGRAGRKRFPASSLYPSGSQTQIETKNPRVNLLVSKWQQVWLLALERRRKLNDALDRLEEVWKFIPSTPHCHLPSFLITHCHCQNLGIF

SEQ ID NO: 26261 - protein, 1143 aa, Homo sapiens
  Payload ID: 5186
  Gene Symbol: DST
  Gene Name: dystonin
  ENSP ID: ENSP00000431003
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEVIINSEHPVNIKELEMSSNYSVVWESKTCFMINLCGR

SEQ ID NO: 26262 - protein, 259 aa, Homo sapiens
  Payload ID: 5186
  Gene Symbol: DST
  Gene Name: dystonin
  ENSP ID: ENSP00000431020
  MOD_RES (1)..(1): Any amino acid
XTRQVAKCKCAKRFQVEQIGDNKYRFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 26263 - protein, 1479 aa, Homo sapiens
  Payload ID: 5186
  Gene Symbol: DST
  Gene Name: dystonin
  ENSP ID: ENSP00000431030
MSSGNASYRCSMSSSADFSDEDDFSQKSGSASPAPGDTLPWNLPKHERSKRKIQGGSVLDPAERAVLRIADERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEK

SEQ ID NO: 26264 - protein, 448 aa, Homo sapiens
  Payload ID: 5186
  Gene Symbol: DST
  Gene Name: dystonin
  ENSP ID: ENSP00000431121
  MOD_RES (1)..(1): Any amino acid
XVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQDVGTGYCRSSEQYKCHE

SEQ ID NO: 26265 - protein, 304 aa, Homo sapiens
  Payload ID: 5186
  Gene Symbol: DST
  Gene Name: dystonin
  ENSP ID: ENSP00000488192
MGNVCGCVRAEKEEQYVDPAKTPLNPEKYSPGRKYFRRKPIKKTGGDKESVGANNENEGKKKSSSQPSKEQPAPLSRGLVQQESVTLNSALGDGIQQKKTEVVADSVKQKLLPSAVSSWSDCVNTSPAKDSETEVKVSELDERISEKDSTPYCAKRKKHLDDVNTSEITFQEKTDVFSFRKAASLSSIPSGIERSLEKSGFPEDPPKSYSSIQEKQNTERFCPHATQHFQFKKKRCHSLYTSMSSVSKDTDGNEISDIHVTGESEDMSAKERLLLWTQQATEGYAGIRCENFTTCWRDGKLFNA

SEQ ID NO: 26266 - protein, 1674 aa, Homo sapiens
  Payload ID: 5186
  Gene Symbol: DST
  Gene Name: dystonin
  ENSP ID: ENSP00000489032
MGKPLSRPDCLRQNPPCVGKGEEEEDLNIEDCYVPQRSIYDTVRLNEQIDSGSKGSLSSRHFTDRTLPYSHRTLDVSSLCSNGALTSSSVFELRGREANKLDEKMIFDALKLNSDIIRTTGLPKAKSHAEKKEHRRSWRMFVPANFMDYANKSESSFVEPADMSDAVTKASKCRWGTNSLTSEEDDSGLCSPPAEREEKQGILTGDQSRIKSLSSTEDILVTDQYRPFFSVNSISEQKIPLLSCQSAHPDENFKMILHDVSPLEEAKHVNGQREIHDENCCLQNNLKESPVKCDPLIMPRNRENEHIFNLGEEDETYGPGESQITAQSRELLKDSPQDLDLSHTDLGESDVDCGSTSLVENVTLLTQYDSGECNIASKEEVEAPLSAQESEMLYKKFSLKFVSARKKAAPRKTGAQAGILDTVCNGFQLVQVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQD

SEQ ID NO: 26267 - protein, 6 aa, Homo sapiens
  Payload ID: 5186
  Gene Symbol: DST
  Gene Name: dystonin
  ENSP ID: ENSP00000489111
MVDTEE

SEQ ID NO: 26268 - protein, 351 aa, Homo sapiens
  Payload ID: 5187
  Gene Symbol: DTNBP1
  Gene Name: dystrobrevin binding protein 1
  Uniprot ID: Q96EV8
  ENSP ID: ENSP00000341680
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 26269 - protein, 303 aa, Homo sapiens
  Payload ID: 5187
  Gene Symbol: DTNBP1
  Gene Name: dystrobrevin binding protein 1
  Uniprot ID: Q96EV8
  ENSP ID: ENSP00000344718
MLETLRERLLSVQQDFTSGLKTLSDKSREAKVKSKPRTVPFLPKYSAGLELLSRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGRVDKLALAEPGQYRCHSPPKVRRENHLPVTYA

SEQ ID NO: 26270 - protein, 334 aa, Homo sapiens
  Payload ID: 5187
  Gene Symbol: DTNBP1
  Gene Name: dystrobrevin binding protein 1
  ENSP ID: ENSP00000348183
MLETLRERLLSVQQDFTSGLKTLSDKSREAKVKSKPRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 26271 - protein, 142 aa, Homo sapiens
  Payload ID: 5187
  Gene Symbol: DTNBP1
  Gene Name: dystrobrevin binding protein 1
  ENSP ID: ENSP00000421797
MEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEE

SEQ ID NO: 26272 - protein, 46 aa, Homo sapiens
  Payload ID: 5187
  Gene Symbol: DTNBP1
  Gene Name: dystrobrevin binding protein 1
  ENSP ID: ENSP00000424202
MLETLRERLLSVQQDFTSGSLSADKPLDCQCVPLACHLVEKQLISK

SEQ ID NO: 26273 - protein, 46 aa, Homo sapiens; identical to SEQ ID NO: 26272
  Payload ID: 5187
  Gene Symbol: DTNBP1
  Gene Name: dystrobrevin binding protein 1
  ENSP ID: ENSP00000424357

SEQ ID NO: 26274 - protein, 44 aa, Homo sapiens
  Payload ID: 5187
  Gene Symbol: DTNBP1
  Gene Name: dystrobrevin binding protein 1
  ENSP ID: ENSP00000424685
MLETLRERLLSVQQDFTSGLKTLSDKSREAKVKSKPSWLNQEQF

SEQ ID NO: 26275 - protein, 208 aa, Homo sapiens
  Payload ID: 5187
  Gene Symbol: DTNBP1
  Gene Name: dystrobrevin binding protein 1
  ENSP ID: ENSP00000425495
MLETLRERLLSVQQDFTSGLKTLSDKSREAKVKSKPRYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERRGDP

SEQ ID NO: 26276 - protein, 195 aa, Homo sapiens
  Payload ID: 5187
  Gene Symbol: DTNBP1
  Gene Name: dystrobrevin binding protein 1
  ENSP ID: ENSP00000427239
MSSPGLTENSQRDPSELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 26277 - protein, 230 aa, Homo sapiens
  Payload ID: 5187
  Gene Symbol: DTNBP1
  Gene Name: dystrobrevin binding protein 1
  ENSP ID: ENSP00000427473
MLETLRERLLSVQQDFTSGYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTV

SEQ ID NO: 26278 - protein, 316 aa, Homo sapiens
  Payload ID: 5187
  Gene Symbol: DTNBP1
  Gene Name: dystrobrevin binding protein 1
  ENSP ID: ENSP00000481997
MLETLRERLLSVQQDFTSGYEDTWAALHRRAKDCASAGELVDSEVVMLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 26279 - protein, 452 aa, Homo sapiens
  Payload ID: 5188
  Gene Symbol: DTNA
  Gene Name: dystrobrevin, alpha
  Uniprot ID: Q9Y4J8
  ENSP ID: ENSP00000269192
MFPDQPEKPLNLAHIVPPRPVTSMNDTLFSHSVPSSGSPFITRRLPEGISASSPVAEEHSLIKLYVNQLDHGARSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 26280 - protein, 686 aa, Homo sapiens
  Payload ID: 5188
  Gene Symbol: DTNA
  Gene Name: dystrobrevin, alpha
  Uniprot ID: Q9Y4J8
  ENSP ID: ENSP00000283365
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVDTWPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 26281 - protein, 374 aa, Homo sapiens
  Payload ID: 5188
  Gene Symbol: DTNA
  Gene Name: dystrobrevin, alpha
  Uniprot ID: Q9Y4J8
  ENSP ID: ENSP00000322519
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVDTWPPRPVTSMNDTLFSHSVPSSGSPFITRSSDGAFGGCV

SEQ ID NO: 26282 - protein, 567 aa, Homo sapiens
  Payload ID: 5188
  Gene Symbol: DTNA
  Gene Name: dystrobrevin, alpha
  Uniprot ID: Q9Y4J8
  ENSP ID: ENSP00000336682
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGVSYVPYCRS

SEQ ID NO: 26283 - protein, 743 aa, Homo sapiens
  Payload ID: 5188
  Gene Symbol: DTNA
  Gene Name: dystrobrevin, alpha
  Uniprot ID: Q9Y4J8
  ENSP ID: ENSP00000382064
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVDTWPPRPVTSMNDTLFSHSVPSSGSPFITRSSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 26284 - protein, 690 aa, Homo sapiens
  Payload ID: 5188
  Gene Symbol: DTNA
  Gene Name: dystrobrevin, alpha
  Uniprot ID: Q9Y4J8
  ENSP ID: ENSP00000382072
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 26285 - protein, 743 aa, Homo sapiens; identical to SEQ ID NO: 26283
  Payload ID: 5188
  Gene Symbol: DTNA
  Gene Name: dystrobrevin, alpha
  Uniprot ID: Q9Y4J8
  ENSP ID: ENSP00000405819

SEQ ID NO: 26286 - protein, 371 aa, Homo sapiens
  Payload ID: 5188
  Gene Symbol: DTNA
  Gene Name: dystrobrevin, alpha
  Uniprot ID: Q9Y4J8
  ENSP ID: ENSP00000451516
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSSDGAFGGCV

SEQ ID NO: 26287 - protein, 395 aa, Homo sapiens
  Payload ID: 5188
  Gene Symbol: DTNA
  Gene Name: dystrobrevin, alpha
  Uniprot ID: Q9Y4J8
  ENSP ID: ENSP00000452255
MFPDQPEKPLNLAHIVPPRPVTSMNDTLFSHSVPSSGSPFITRRLPEGISASSPVAEEHSLIKLYVNQLDHGARMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 26288 - protein, 18 aa, Homo sapiens
  Payload ID: 5188
  Gene Symbol: DTNA
  Gene Name: dystrobrevin, alpha
  ENSP ID: ENSP00000464904
MIEDSGKRGNTMAERRQL

SEQ ID NO: 26289 - protein, 119 aa, Homo sapiens
  Payload ID: 5188
  Gene Symbol: DTNA
  Gene Name: dystrobrevin, alpha
  ENSP ID: ENSP00000465063
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAF

SEQ ID NO: 26290 - protein, 33 aa, Homo sapiens
  Payload ID: 5188
  Gene Symbol: DTNA
  Gene Name: dystrobrevin, alpha
  ENSP ID: ENSP00000466573
MAERRQLFAEMRAQDLDRIRLSTYRTACKLRFV

SEQ ID NO: 26291 - protein, 43 aa, Homo sapiens
  Payload ID: 5188
  Gene Symbol: DTNA
  Gene Name: dystrobrevin, alpha
  ENSP ID: ENSP00000466978
MIEDSGKRGNTMAERRQLFAEMRAQDLDRIRLSTYRTACKLRF

SEQ ID NO: 26292 - protein, 391 aa, Homo sapiens
  Payload ID: 5188
  Gene Symbol: DTNA
  Gene Name: dystrobrevin, alpha
  Uniprot ID: Q9Y4J8
  ENSP ID: ENSP00000467720
MFPDQPEKPLNLAHIVPPRPVTSMNDTLFSHSVPSSGSPFITRSSPPKDSEVEQNKLLARAAPAFLKGKGMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 26293 - protein, 104 aa, Homo sapiens
  Payload ID: 5188
  Gene Symbol: DTNA
  Gene Name: dystrobrevin, alpha
  ENSP ID: ENSP00000468138
MMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSS

SEQ ID NO: 26294 - protein, 109 aa, Homo sapiens
  Payload ID: 5188
  Gene Symbol: DTNA
  Gene Name: dystrobrevin, alpha
  ENSP ID: ENSP00000468262
MNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQ

SEQ ID NO: 26295 - protein, 133 aa, Homo sapiens
  Payload ID: 5188
  Gene Symbol: DTNA
  Gene Name: dystrobrevin, alpha
  ENSP ID: ENSP00000468473
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVK

SEQ ID NO: 26296 - protein, 101 aa, Homo sapiens
  Payload ID: 5188
  Gene Symbol: DTNA
  Gene Name: dystrobrevin, alpha
  ENSP ID: ENSP00000468631
MCGTVSSPGIVTFVQLQIQQSKEPRAQDLDRIRLSTYRTACKLRFVQKKCNLHLVDIWNVIEALRENALNNLDPNTELNVSRLEAVLSTIFYQLNKRMPTT

SEQ ID NO: 26297 - protein, 320 aa, Homo sapiens
  Payload ID: 5188
  Gene Symbol: DTNA
  Gene Name: dystrobrevin, alpha
  Uniprot ID: Q9Y4J8
  ENSP ID: ENSP00000469121
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGVSYVPYCRS

SEQ ID NO: 26298 - protein, 724 aa, Homo sapiens
  Payload ID: 5188
  Gene Symbol: DTNA
  Gene Name: dystrobrevin, alpha
  Uniprot ID: Q9Y4J8
  ENSP ID: ENSP00000470152
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQLHVSTETRLEHPCPVSETKWRVLFWGFVFFGGFLSLALQIYFWGLF

SEQ ID NO: 26299 - protein, 365 aa, Homo sapiens
  Payload ID: 5188
  Gene Symbol: DTNA
  Gene Name: dystrobrevin, alpha
  ENSP ID: ENSP00000470247
MFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 26300 - protein, 686 aa, Homo sapiens; identical to SEQ ID NO: 26280
  Payload ID: 5188
  Gene Symbol: DTNA
  Gene Name: dystrobrevin, alpha
  Uniprot ID: Q9Y4J8
  ENSP ID: ENSP00000470716

SEQ ID NO: 26301 - protein, 162 aa, Homo sapiens
  Payload ID: 5188
  Gene Symbol: DTNA
  Gene Name: dystrobrevin, alpha
  ENSP ID: ENSP00000470934
MFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLSAKMSWNRECLLSRRAGES

SEQ ID NO: 26302 - protein, 169 aa, Homo sapiens
  Payload ID: 5188
  Gene Symbol: DTNA
  Gene Name: dystrobrevin, alpha
  ENSP ID: ENSP00000471143
MPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 26303 - protein, 192 aa, Homo sapiens
  Payload ID: 5188
  Gene Symbol: DTNA
  Gene Name: dystrobrevin, alpha
  Uniprot ID: Q9Y4J8
  ENSP ID: ENSP00000471783
MFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGVSYVPYCRS

SEQ ID NO: 26304 - protein, 513 aa, Homo sapiens
  Payload ID: 5188
  Gene Symbol: DTNA
  Gene Name: dystrobrevin, alpha
  Uniprot ID: Q9Y4J8
  ENSP ID: ENSP00000472031
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVDTWPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGVSYVPYCRS

SEQ ID NO: 26305 - protein, 683 aa, Homo sapiens
  Payload ID: 5188
  Gene Symbol: DTNA
  Gene Name: dystrobrevin, alpha
  Uniprot ID: Q9Y4J8
  ENSP ID: ENSP00000473078
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 26306 - protein, 510 aa, Homo sapiens
  Payload ID: 5188
  Gene Symbol: DTNA
  Gene Name: dystrobrevin, alpha
  Uniprot ID: Q9Y4J8
  ENSP ID: ENSP00000473119
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVPPRPVTSMNDTLFSHSVPSSGSPFITRSMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKEEELKQGVSYVPYCRS

SEQ ID NO: 26307 - protein, 620 aa, Homo sapiens
  Payload ID: 5189
  Gene Symbol: DTNB
  Gene Name: dystrobrevin, beta
  ENSP ID: ENSP00000288642
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKAQATGSPHTSPTHGGGRPMPMPVRSTSAGSTPTHCPQDSLSGVGGDVQEAFAQGTRRNLRNDLLVAADSITNTMSSLVKELHSAEEGAEEEEEKMQNGKDRG

SEQ ID NO: 26308 - protein, 188 aa, Homo sapiens
  Payload ID: 5189
  Gene Symbol: DTNB
  Gene Name: dystrobrevin, beta
  ENSP ID: ENSP00000306529
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFG

SEQ ID NO: 26309 - protein, 132 aa, Homo sapiens
  Payload ID: 5189
  Gene Symbol: DTNB
  Gene Name: dystrobrevin, beta
  ENSP ID: ENSP00000340957
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSV

SEQ ID NO: 26310 - protein, 63 aa, Homo sapiens
  Payload ID: 5189
  Gene Symbol: DTNB
  Gene Name: dystrobrevin, beta
  ENSP ID: ENSP00000349007
MIEESGNKRKTMAEKRQLFIEMRAQNFDVIRLSTYRTACKLRFVQKRCNQKDNAKYVFRHNDG

SEQ ID NO: 26311 - protein, 149 aa, Homo sapiens
  Payload ID: 5189
  Gene Symbol: DTNB
  Gene Name: dystrobrevin, beta
  ENSP ID: ENSP00000381924
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLR

SEQ ID NO: 26312 - protein, 627 aa, Homo sapiens
  Payload ID: 5189
  Gene Symbol: DTNB
  Gene Name: dystrobrevin, beta
  Uniprot ID: O60941
  ENSP ID: ENSP00000384084
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQGTRRNLRNDLLVAADSITNTMSSLVKELHSAEEGAEEEEEKMQNGKDRG

SEQ ID NO: 26313 - protein, 567 aa, Homo sapiens
  Payload ID: 5189
  Gene Symbol: DTNB
  Gene Name: dystrobrevin, beta
  Uniprot ID: O60941
  ENSP ID: ENSP00000384767
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQAEEGAEEEEEKMQNGKDRG

SEQ ID NO: 26314 - protein, 560 aa, Homo sapiens
  Payload ID: 5189
  Gene Symbol: DTNB
  Gene Name: dystrobrevin, beta
  Uniprot ID: O60941
  ENSP ID: ENSP00000384787
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKAQATGSPHTSPTHGGGRPMPMPVRSTSAGSTPTHCPQDSLSGVGGDVQEAFAQAEEGAEEEEEKMQNGKDRG

SEQ ID NO: 26315 - protein, 609 aa, Homo sapiens
  Payload ID: 5189
  Gene Symbol: DTNB
  Gene Name: dystrobrevin, beta
  Uniprot ID: O60941
  ENSP ID: ENSP00000385193
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQGTRRNLRNDLLVAADSITNTMSSLVKELHSG

SEQ ID NO: 26316 - protein, 597 aa, Homo sapiens
  Payload ID: 5189
  Gene Symbol: DTNB
  Gene Name: dystrobrevin, beta
  Uniprot ID: O60941
  ENSP ID: ENSP00000385482
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKEEEQKQAAQATGSPHTSPTHGGGRPMPMPVRSTSAGSTPTHCPQDSLSGVGGDVQEAFAQAEEGAEEEEEKMQNGKDRG

SEQ ID NO: 26317 - protein, 590 aa, Homo sapiens
  Payload ID: 5189
  Gene Symbol: DTNB
  Gene Name: dystrobrevin, beta
  ENSP ID: ENSP00000385784
MIEESGNKRKTMAEKRQLFIEMRAQNFDVIRLSTYRTACKLRFVQKRCNLHLVDIWNMIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKSVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKAQATGSPHTSPTHGGGRPMPMPVRSTSAGSTPTHCPQDSLSGVGGDVQEAFAQGTRRNLRNDLLVAADSITNTMSSLVKELHSAEEGAEEEEEKMQNGKDRG

SEQ ID NO: 26318 - protein, 545 aa, Homo sapiens
  Payload ID: 5189
  Gene Symbol: DTNB
  Gene Name: dystrobrevin, beta
  Uniprot ID: O60941
  ENSP ID: ENSP00000444463
MIEAFRDNGLNTLDHTTEISVSRLETVISSIYYQLNKRLPSTHQISVEQSISLLLNFMIAAYDSEGRGKLTVFSVKAMLATMCGGKMLDKLRYVFSQMSDSNGLMIFSKFDQFLKEVLKLPTAVFEGPSFGYTEHSVRTCFPQQRKIMLNMFLDTMMADPPPQCLVWLPLMHRLAHVENVFHPVECSYCRCESMMGFRYRCQQCHNYQLCQNCFWRGHAGGPHSNQHQMKEHSSWKSPAKKLSHAISKSLGCVPTREPPHPVFPEQPEKPLDLAHIVPPRPLTNMNDTMVSHMSSGVPTPTKRLQYSQDIPSHLADEHALIASYVARLQHCARVLDSPSRLDEEHRLIARYAARLAAEAGNVTRPPTDLSFNFDANKQQRQLIAELENKNREILQEIQRLRLEHEQASQPTPEKAQQNPTLLAELRLLRQRKDELEQRMSALQESRRELMVQLEELMKLLKAQATGSPHTSPTHGGGRPMPMPVRSTSAGSTPTHCPQDSLSGVGGDVQEAFAQGTRRNLRNDLLVAADSITNTMSSLVKELHSG

SEQ ID NO: 26319 - protein, 895 aa, Homo sapiens
  Payload ID: 5190
  Gene Symbol: DAG1
  Gene Name: dystroglycan 1 (dystrophin-associated glycoprotein 1)
  Uniprot ID: Q14118
  ENSP ID: ENSP00000312435
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSELQSVRTASPDPGEVVSSACAADEPVTVLTVILDADLTKMTPKQRIDLLHRMRSFSEVELHNMKLVPVVNNRLFDMSAFMAGPGNAKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTAPMEGKGSRPKNMTPYRSPPPYVPP

SEQ ID NO: 26320 - protein, 41 aa, Homo sapiens
  Payload ID: 5190
  Gene Symbol: DAG1
  Gene Name: dystroglycan 1 (dystrophin-associated glycoprotein 1)
  ENSP ID: ENSP00000387859
MRMSVGLSLLLPLSGRTFLLLLSVVMAQSHWPSEPSEAVRD

SEQ ID NO: 26321 - protein, 117 aa, Homo sapiens
  Payload ID: 5190
  Gene Symbol: DAG1
  Gene Name: dystroglycan 1 (dystrophin-associated glycoprotein 1)
  ENSP ID: ENSP00000388833
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTL

SEQ ID NO: 26322 - protein, 95 aa, Homo sapiens
  Payload ID: 5190
  Gene Symbol: DAG1
  Gene Name: dystroglycan 1 (dystrophin-associated glycoprotein 1)
  ENSP ID: ENSP00000401382
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIK

SEQ ID NO: 26323 - protein, 8 aa, Homo sapiens
  Payload ID: 5190
  Gene Symbol: DAG1
  Gene Name: dystroglycan 1 (dystrophin-associated glycoprotein 1)
  ENSP ID: ENSP00000401805
MRMSVGLS

SEQ ID NO: 26324 - protein, 15 aa, Homo sapiens
  Payload ID: 5190
  Gene Symbol: DAG1
  Gene Name: dystroglycan 1 (dystrophin-associated glycoprotein 1)
  ENSP ID: ENSP00000402443
MRMSVGLSLLLPLSG

SEQ ID NO: 26325 - protein, 88 aa, Homo sapiens
  Payload ID: 5190
  Gene Symbol: DAG1
  Gene Name: dystroglycan 1 (dystrophin-associated glycoprotein 1)
  ENSP ID: ENSP00000405859
MRMSVGLSLLLPLSGRTFLLLLSVVMAQSHWPSEPSEAVRDWENQLEASMHSVLSDLHEAVPTVVGIPDGTAVVGRSFRVTIPTDLIA

SEQ ID NO: 26326 - protein, 86 aa, Homo sapiens
  Payload ID: 5190
  Gene Symbol: DAG1
  Gene Name: dystroglycan 1 (dystrophin-associated glycoprotein 1)
  ENSP ID: ENSP00000410145
MRMSVGLSLLLPLSGRTFLLLLSVVMAQSHWPSEPSEAVRDWENQLEASMHSVLSDLHEAVPTVVGIPDGTAVVGRSFRVTIPTDL

SEQ ID NO: 26327 - protein, 106 aa, Homo sapiens
  Payload ID: 5190
  Gene Symbol: DAG1
  Gene Name: dystroglycan 1 (dystrophin-associated glycoprotein 1)
  ENSP ID: ENSP00000412067
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKVSAAGKEALPS

SEQ ID NO: 26328 - protein, 52 aa, Homo sapiens
  Payload ID: 5190
  Gene Symbol: DAG1
  Gene Name: dystroglycan 1 (dystrophin-associated glycoprotein 1)
  ENSP ID: ENSP00000415321
MRMSVGLSLLLPLSGRTFLLLLSVVMAQSHWPSEPSEAVRDWENQLEASMHS

SEQ ID NO: 26329 - protein, 895 aa, Homo sapiens; identical to SEQ ID NO: 26319
  Payload ID: 5190
  Gene Symbol: DAG1
  Gene Name: dystroglycan 1 (dystrophin-associated glycoprotein 1)
  Uniprot ID: Q14118
  ENSP ID: ENSP00000438421

SEQ ID NO: 26330 - protein, 895 aa, Homo sapiens; identical to SEQ ID NO: 26319
  Payload ID: 5190
  Gene Symbol: DAG1
  Gene Name: dystroglycan 1 (dystrophin-associated glycoprotein 1)
  Uniprot ID: Q14118
  ENSP ID: ENSP00000439334

SEQ ID NO: 26331 - protein, 895 aa, Homo sapiens; identical to SEQ ID NO: 26319
  Payload ID: 5190
  Gene Symbol: DAG1
  Gene Name: dystroglycan 1 (dystrophin-associated glycoprotein 1)
  Uniprot ID: Q14118
  ENSP ID: ENSP00000440590

SEQ ID NO: 26332 - protein, 895 aa, Homo sapiens; identical to SEQ ID NO: 26319
  Payload ID: 5190
  Gene Symbol: DAG1
  Gene Name: dystroglycan 1 (dystrophin-associated glycoprotein 1)
  Uniprot ID: Q14118
  ENSP ID: ENSP00000440705

SEQ ID NO: 26333 - protein, 895 aa, Homo sapiens; identical to SEQ ID NO: 26319
  Payload ID: 5190
  Gene Symbol: DAG1
  Gene Name: dystroglycan 1 (dystrophin-associated glycoprotein 1)
  Uniprot ID: Q14118
  ENSP ID: ENSP00000442600

SEQ ID NO: 26334 - protein, 674 aa, Homo sapiens
  Payload ID: 5191
  Gene Symbol: DMWD
  Gene Name: dystrophia myotonica, WD repeat containing
  Uniprot ID: Q09019
  ENSP ID: ENSP00000270223
MAAGGAEGGSGPGAAMGDCAEIKSQFRTREGFYKLLPGDGAARRSGPASAQTPVPPQPPQPPPGPASASGPGAAGPASSPPPAGPGPGPALPAVRLSLVRLGEPDSAGAGEPPATPAGLGSGGDRVCFNLGRELYFYPGCCRRGSQRSIDLNKPIDKRIYKGTQPTCHDFNQFTAATETISLLVGFSAGQVQYLDLIKKDTSKLFNEERLIDKTKVTYLKWLPESESLFLASHASGHLYLYNVSHPCASAPPQYSLLKQGEGFSVYAAKSKAPRNPLAKWAVGEGPLNEFAFSPDGRHLACVSQDGCLRVFHFDSMLLRGLMKSYFGGLLCVCWSPDGRYVVTGGEDDLVTVWSFTEGRVVARGHGHKSWVNAVAFDPYTTRAEEAATAAGADGERSGEEEEEEPEAAGTGSAGGAPLSPLPKAGSITYRFGSAGQDTQFCLWDLTEDVLYPHPPLARTRTLPGTPGTTPPAASSSRGGEPGPGPLPRSLSRSNSLPHPAGGGKAGGPGVAAEPGTPFSIGRFATLTLQERRDRGAEKEHKRYHSLGNISRGGSGGSGSGGEKPSGPVPRSRLDPAKVLGTALCPRIHEVPLLEPLVCKKIAQERLTVLLFLEDCIITACQEGLICTWARPGKAFTDEETEAQTGEGSWPRSPSKSVVEGISSQPGNSPSGTVV

SEQ ID NO: 26335 - protein, 649 aa, Homo sapiens
  Payload ID: 5191
  Gene Symbol: DMWD
  Gene Name: dystrophia myotonica, WD repeat containing
  ENSP ID: ENSP00000366964
MAAGGAEGGSGPGAAMGDCAEIKSQFRTREGFYKLLPGDGAARRSGPASAQTPVPPQPPQPPPGPASASGPGAAGPASSPPPAGPGPGPALPAVRLSLVRLGEPDSAGAGEPPATPAGLGSGGDRVCFNLGRELYFYPGCCRRGSQRSIDLNKPIDKRIYKGTQPTCHDFNQFTAATETISLLVGFSAGQVQYLDLIKKDTSKLFNEERLIDKTKVTYLKWLPESESLFLASHASGHLYLYNVSHPCASAPPQYSLLKQGEGFSVYAAKSKAPRNPLAKWAVGEGPLNEFAFSPDGRHLACVSQDGCLRVFHFDSMLLRGLMKSYFGGLLCVCWSPDGRYVVTGGEDDLVTVWSFTEGRVVARGHGHKSWVNAVAFDPYTTRAEEAATAAGADGERSGEEEEEEPEAAGTGSAGGAPLSPLPKAGSITYRFGSAGQDTQFCLWDLTEDVLYPHPPLARTRTLPGTPGTTPPAASSSRGGEPGPGPLPRSLSRSNSLPHPAGGGKAGGPGVAAEPGTPFSIGRFATLTLQERRDRGAEKEHKRYHSLGNISRGGSGGSGSGGEKPSGPVPRSRLDPAKVLGTALCPRIHEVPLLEPLVCKKIAQERLTVLLFLEDCIITACQEGLICTWARPGKAGISSQPGNSPSGTVV

SEQ ID NO: 26336 - protein, 64 aa, Homo sapiens
  Payload ID: 5191
  Gene Symbol: DMWD
  Gene Name: dystrophia myotonica, WD repeat containing
  ENSP ID: ENSP00000444820
EDCIITACQEGLICTWARPGKAFTDEETEAQTGEGSWPRSPSKSVVEVGLSLSSFPSTSGSLPS

SEQ ID NO: 26337 - protein, 161 aa, Homo sapiens
  Payload ID: 5191
  Gene Symbol: DMWD
  Gene Name: dystrophia myotonica, WD repeat containing
  ENSP ID: ENSP00000473377
  MOD_RES (1)..(1): Any amino acid
XERRDRGAEKEHKRYHSLGNISRGGSGGSGSGGEKPSGPVPRSRLDPAKVLGTALCPRIHEVPLLEPLVCKKIAQERLTVLLFLEDCIITACQEGLICTWARPGKAVSGPTPACRGPGRTFRGKRQALAERGLCCCHSLWLRGVRGSQGNLSVSVQDLSDP

SEQ ID NO: 26338 - protein, 149 aa, Homo sapiens
  Payload ID: 5191
  Gene Symbol: DMWD
  Gene Name: dystrophia myotonica, WD repeat containing
  ENSP ID: ENSP00000473415
  MOD_RES (1)..(1): Any amino acid
XGAGEPPATPAGLGSGGDRVCFNLGRELYFYPGCCRRGSQRSIDLNKPIDKRIYKGTQPTCHDFNQFTAATETISLLVGFSAGQVQYLDLIKKDTSKLFNEEVIAAPRAPNFSAFSPTHYMPLGCSCLRNSVGLRGAGPGRDGEWGDSS

SEQ ID NO: 26339 - protein, 102 aa, Homo sapiens
  Payload ID: 5191
  Gene Symbol: DMWD
  Gene Name: dystrophia myotonica, WD repeat containing
  ENSP ID: ENSP00000473426
GTQPTCHDFNQFTAATETISLLVGFSAGQVQYLDLIKKDTSKLFNEEDRCCRIIHGDCSVLGQLGLRGDTSKRPYPRAGTALGFCLILSGPEEVFHKYSQNE

SEQ ID NO: 26340 - protein, 629 aa, Homo sapiens
  Payload ID: 5192
  Gene Symbol: DMPK
  Gene Name: dystrophia myotonica-protein kinase
  Uniprot ID: Q09013
  ENSP ID: ENSP00000291270
MSAEVRLRRLQQLVLDPGFLGLEPLLDLLLGVHQELGASELAQDKYVADFLQWAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMVSGGGETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 26341 - protein, 639 aa, Homo sapiens
  Payload ID: 5192
  Gene Symbol: DMPK
  Gene Name: dystrophia myotonica-protein kinase
  Uniprot ID: Q09013
  ENSP ID: ENSP00000345997
MGGHFWPPEPYTVFMWGSPWEADSPRVKLRGREKGRQTEGGAFPLVSSALSGDPRFFSPTTPPAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMVSGGGETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 26342 - protein, 530 aa, Homo sapiens
  Payload ID: 5192
  Gene Symbol: DMPK
  Gene Name: dystrophia myotonica-protein kinase
  Uniprot ID: Q09013
  ENSP ID: ENSP00000346168
MSAEVRLRRLQQLVLDPGFLGLEPLLDLLLGVHQELGASELAQDKYVADFLQWAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATGP

SEQ ID NO: 26343 - protein, 625 aa, Homo sapiens
  Payload ID: 5192
  Gene Symbol: DMPK
  Gene Name: dystrophia myotonica-protein kinase
  Uniprot ID: Q09013
  ENSP ID: ENSP00000401753
MSAEVRLRRLQQLVLDPGFLGLEPLLDLLLGVHQELGASELAQDKYVADFLQWAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHMAPRPWLWASARWWGQAPCTAATCCSLPGSLGLAYRRRFPCSCSPLFCLVPPPWAALGWWPTPANSPQSGAAQEPPALPEP

SEQ ID NO: 26344 - protein, 624 aa, Homo sapiens
  Payload ID: 5192
  Gene Symbol: DMPK
  Gene Name: dystrophia myotonica-protein kinase
  Uniprot ID: Q09013
  ENSP ID: ENSP00000413417
MSAEVRLRRLQQLVLDPGFLGLEPLLDLLLGVHQELGASELAQDKYVADFLQWAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 26345 - protein, 78 aa, Homo sapiens
  Payload ID: 5192
  Gene Symbol: DMPK
  Gene Name: dystrophia myotonica-protein kinase
  ENSP ID: ENSP00000468013
MSAEVRLRRLQQLVLDPGFLGLEPLLDLLLGVHQELGASELAQDKYVADFLQWAPNPGFSKVWFKNHLHLNLERSPSW

SEQ ID NO: 26346 - protein, 183 aa, Homo sapiens
  Payload ID: 5192
  Gene Symbol: DMPK
  Gene Name: dystrophia myotonica-protein kinase
  ENSP ID: ENSP00000469220
  MOD_RES (1)..(1): Any amino acid
XDWDGLRDSVPPFTPDFEGATDTCNFDLVEDGLTAMVSGGGETLSDIREGAPLGVHLPFVGYSYSCMALRDSEVPGPTPMELEAEQLLEPHVQAPSLEPSVSPQDETSTTRGRGSEPGPRGTRPAVAGADGVAAGRGSHRSLGLAYRRRFPCSCSPLFCLVPPPWAALGWWPTPANSPQSGAA

SEQ ID NO: 26347 - protein, 125 aa, Homo sapiens
  Payload ID: 5192
  Gene Symbol: DMPK
  Gene Name: dystrophia myotonica-protein kinase
  ENSP ID: ENSP00000470192
MLPLSPCPVPSPSPKSRVFQSVVQEPPASESRAEPIVVRLKEVRLQRDDFEILKVIGRGAFSEVAVVKMKQTGQVYAMKIMNKWDMLKRGEVSCFREERDVLVNGDRRWITQLHFAFQDENYLYL

SEQ ID NO: 26348 - protein, 188 aa, Homo sapiens
  Payload ID: 5192
  Gene Symbol: DMPK
  Gene Name: dystrophia myotonica-protein kinase
  ENSP ID: ENSP00000471832
AEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHVRPLSFPCLRPAAHSADPLPGSWSPRPDIGLTLRLCDFRGQKPFIQPQISLRSGLTRFPPGSP

SEQ ID NO: 26349 - protein, 635 aa, Homo sapiens
  Payload ID: 5192
  Gene Symbol: DMPK
  Gene Name: dystrophia myotonica-protein kinase
  ENSP ID: ENSP00000472965
MGGHFWPPEPYTVFMWGSPWEADSPRVKLRGREKGRQTEGGAFPLVSSALSGDPRFFSPTTPPAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHMAPRPWLWASARWWGQAPCTAATCCSLPGSLGLAYRRRFPCSCSPLFCLVPPPWAALGWWPTPANSPQSGAAQEPPALPEP

SEQ ID NO: 26350 - protein, 625 aa, Homo sapiens; identical to SEQ ID NO: 26343
  Payload ID: 5192
  Gene Symbol: DMPK
  Gene Name: dystrophia myotonica-protein kinase
  Uniprot ID: Q09013
  ENSP ID: ENSP00000482746

SEQ ID NO: 26351 - protein, 772 aa, Homo sapiens
  Payload ID: 5193
  Gene Symbol: DMD
  Gene Name: dystrophin
  ENSP ID: ENSP00000288447
MEDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNVGYALIFISVLILCCL

SEQ ID NO: 26352 - protein, 956 aa, Homo sapiens
  Payload ID: 5193
  Gene Symbol: DMD
  Gene Name: dystrophin
  ENSP ID: ENSP00000340057
MLHRKTYHVKDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 26353 - protein, 1386 aa, Homo sapiens
  Payload ID: 5193
  Gene Symbol: DMD
  Gene Name: dystrophin
  ENSP ID: ENSP00000350765
VSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 26354 - protein, 1230 aa, Homo sapiens
  Payload ID: 5193
  Gene Symbol: DMD
  Gene Name: dystrophin
  ENSP ID: ENSP00000352894
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 26355 - protein, 622 aa, Homo sapiens
  Payload ID: 5193
  Gene Symbol: DMD
  Gene Name: dystrophin
  Uniprot ID: P11532
  ENSP ID: ENSP00000354464
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 26356 - protein, 3685 aa, Homo sapiens
  Payload ID: 5193
  Gene Symbol: DMD
  Gene Name: dystrophin
  ENSP ID: ENSP00000354923
MLWWEEVEDCYEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 26357 - protein, 3681 aa, Homo sapiens
  Payload ID: 5193
  Gene Symbol: DMD
  Gene Name: dystrophin
  ENSP ID: ENSP00000367948
MSEVSSDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 26358 - protein, 525 aa, Homo sapiens
  Payload ID: 5193
  Gene Symbol: DMD
  Gene Name: dystrophin
  Uniprot ID: P11532
  ENSP ID: ENSP00000367951
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 26359 - protein, 617 aa, Homo sapiens
  Payload ID: 5193
  Gene Symbol: DMD
  Gene Name: dystrophin
  Uniprot ID: P11532
  ENSP ID: ENSP00000367974
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 26360 - protein, 238 aa, Homo sapiens
  Payload ID: 5193
  Gene Symbol: DMD
  Gene Name: dystrophin
  ENSP ID: ENSP00000367977
LEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRDDEHL

SEQ ID NO: 26361 - protein, 1225 aa, Homo sapiens
  Payload ID: 5193
  Gene Symbol: DMD
  Gene Name: dystrophin
  ENSP ID: ENSP00000367979
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 26362 - protein, 635 aa, Homo sapiens
  Payload ID: 5193
  Gene Symbol: DMD
  Gene Name: dystrophin
  Uniprot ID: P11532
  ENSP ID: ENSP00000367997
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 26363 - protein, 41 aa, Homo sapiens
  Payload ID: 5193
  Gene Symbol: DMD
  Gene Name: dystrophin
  ENSP ID: ENSP00000388559
MLWWEEVEDCYEREDVQKKTFTKWVNAQFSKEYQKHMETFD

SEQ ID NO: 26364 - protein, 125 aa, Homo sapiens
  Payload ID: 5193
  Gene Symbol: DMD
  Gene Name: dystrophin
  ENSP ID: ENSP00000395904
ENLFSDLQDGRRLLDLLEGLTGQKLPKEKGSTRVHALNNVNKALRVLQNNNVDLVNIGSTDIVDGNHKLTLGLIWNIILHWQVLGDRWANICRWTEDRWVLLQDILLKWQRLTEEQCLFSAWLSE

SEQ ID NO: 26365 - protein, 101 aa, Homo sapiens
  Payload ID: 5193
  Gene Symbol: DMD
  Gene Name: dystrophin
  ENSP ID: ENSP00000399897
MLWWEEVEDCYEREDVQKKTFTKWVNAQFSKATQKEIEKQKVHLKSITEVGEALKTVLGKKETLVEDKLSLLNSNWIAVTSRAEEWLNLLLEYQKHMETFD

SEQ ID NO: 26366 - protein, 30 aa, Homo sapiens
  Payload ID: 5193
  Gene Symbol: DMD
  Gene Name: dystrophin
  ENSP ID: ENSP00000417075
VEEILSKGQHLYKEKPATQPVKLLLRLLLW

SEQ ID NO: 26367 - protein, 1243 aa, Homo sapiens
  Payload ID: 5193
  Gene Symbol: DMD
  Gene Name: dystrophin
  ENSP ID: ENSP00000417123
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 26368 - protein, 134 aa, Homo sapiens
  Payload ID: 5193
  Gene Symbol: DMD
  Gene Name: dystrophin
  ENSP ID: ENSP00000417725
ELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKMN

SEQ ID NO: 26369 - protein, 1115 aa, Homo sapiens
  Payload ID: 5193
  Gene Symbol: DMD
  Gene Name: dystrophin
  ENSP ID: ENSP00000444119
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 26370 - protein, 3684 aa, Homo sapiens
  Payload ID: 5193
  Gene Symbol: DMD
  Gene Name: dystrophin
  ENSP ID: ENSP00000478150
MLWWEEVEDCYEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKVSLFVFSKHTFCLQRQKTGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 26371 - protein, 3680 aa, Homo sapiens
  Payload ID: 5193
  Gene Symbol: DMD
  Gene Name: dystrophin
  ENSP ID: ENSP00000479270
MSEVSSDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKVSLFVFSKHTFCLQRQKTGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 26372 - protein, 353 aa, Homo sapiens
  Payload ID: 5194
  Gene Symbol: DRP2
  Gene Name: dystrophin related protein 2
  ENSP ID: ENSP00000362007
MQPMVMQGCPYTLPRCHDWQAADQFHHSSSLRSTCPHPQVRAAVTSPAPPQDGAGVPCLSLKLLNGSVGASGPLEPPAMNLCWNEIKKKSHNLRARLEAFSDHSGKLQLPLQEIIDWLSQKDEELSAQLPLQGDVALVQQEKETHAAFMEEVKSRGPYIYSVLESAQAFLSQHPFEELEEPHSESKDTSPKQRIQNLSRFVWKQATVASELWEKLTARCVDQHRHIERTLEQLLEIQGAMEELSTTLSQAEGVRATWEPIGDLFIDSLPEHIQAIKLFKEEFSPMKDGVKLVNDLAHQLAISDVHLSMENSQALEQINVRWKQLQASVSERLKQLQDAHRDFGPGSQHFLSCT

SEQ ID NO: 26373 - protein, 957 aa, Homo sapiens
  Payload ID: 5194
  Gene Symbol: DRP2
  Gene Name: dystrophin related protein 2
  Uniprot ID: Q13474
  ENSP ID: ENSP00000378635
MQPMVMQGCPYTLPRCHDWQAADQFHHSSSLRSTCPHPQVRAAVTSPAPPQDGAGVPCLSLKLLNGSVGASGPLEPPAMNLCWNEIKKKSHNLRARLEAFSDHSGKLQLPLQEIIDWLSQKDEELSAQLPLQGDVALVQQEKETHAAFMEEVKSRGPYIYSVLESAQAFLSQHPFEELEEPHSESKDTSPKQRIQNLSRFVWKQATVASELWEKLTARCVDQHRHIERTLEQLLEIQGAMEELSTTLSQAEGVRATWEPIGDLFIDSLPEHIQAIKLFKEEFSPMKDGVKLVNDLAHQLAISDVHLSMENSQALEQINVRWKQLQASVSERLKQLQDAHRDFGPGSQHFLSSSVQVPWERAISPNKVPYYINHQAQTTCWDHPKMTELYQTLADLNNIKFSAYRTAMKLRRVQKALRLDLVTLTTALEIFNEHDLQASEHVMDVVEVIHCLTALYERLEEERGILVNVPLCVDMSLNWLLNVFDSGRSGKMRALSFKTGIACLCGTEVKEKLQYLFSQVANSGSQCDQRHLGVLLHEAIQVPRQLGEVAAFGGSNVEPSVRSCFRFSTGKPVIEASQFLEWVNLEPQSMVWLAVLHRVTIAEQVKHQTKCSICRQCPIKGFRYRSLKQFNVDICQTCFLTGRASKGNKLHYPIMEYYTPTTSSENMRDFATTLKNKFRSKHYFSKHPQRGYLPVQSVLEADYSETPASSPMWPHADTHSRIEHFASRLAEMESQNCSFFNDSLSPDDSIDEDQYLLRHSSPITDREPAFGQQAPCSVATESKGELQKILAHLEDENRILQGELRRLKWQHEEAAEAPSLADGSTEAATDHRNEELLAEARILRQHKSRLETRMQILEDHNKQLESQLQRLRELLLQPPTESDGSGSAGSSLASSPQQSEGSHPREKGQTTPDTEAADDVGSKSQDVSLCLEDIMEKLRHAFPSVRSSDVTANTLLAS

SEQ ID NO: 26374 - protein, 957 aa, Homo sapiens; identical to SEQ ID NO: 26373
  Payload ID: 5194
  Gene Symbol: DRP2
  Gene Name: dystrophin related protein 2
  Uniprot ID: Q13474
  ENSP ID: ENSP00000385038

SEQ ID NO: 26375 - protein, 957 aa, Homo sapiens; identical to SEQ ID NO: 26373
  Payload ID: 5194
  Gene Symbol: DRP2
  Gene Name: dystrophin related protein 2
  Uniprot ID: Q13474
  ENSP ID: ENSP00000441051

SEQ ID NO: 26376 - protein, 879 aa, Homo sapiens
  Payload ID: 5194
  Gene Symbol: DRP2
  Gene Name: dystrophin related protein 2
  Uniprot ID: Q13474
  ENSP ID: ENSP00000444752
MNLCWNEIKKKSHNLRARLEAFSDHSGKLQLPLQEIIDWLSQKDEELSAQLPLQGDVALVQQEKETHAAFMEEVKSRGPYIYSVLESAQAFLSQHPFEELEEPHSESKDTSPKQRIQNLSRFVWKQATVASELWEKLTARCVDQHRHIERTLEQLLEIQGAMEELSTTLSQAEGVRATWEPIGDLFIDSLPEHIQAIKLFKEEFSPMKDGVKLVNDLAHQLAISDVHLSMENSQALEQINVRWKQLQASVSERLKQLQDAHRDFGPGSQHFLSSSVQVPWERAISPNKVPYYINHQAQTTCWDHPKMTELYQTLADLNNIKFSAYRTAMKLRRVQKALRLDLVTLTTALEIFNEHDLQASEHVMDVVEVIHCLTALYERLEEERGILVNVPLCVDMSLNWLLNVFDSGRSGKMRALSFKTGIACLCGTEVKEKLQYLFSQVANSGSQCDQRHLGVLLHEAIQVPRQLGEVAAFGGSNVEPSVRSCFRFSTGKPVIEASQFLEWVNLEPQSMVWLAVLHRVTIAEQVKHQTKCSICRQCPIKGFRYRSLKQFNVDICQTCFLTGRASKGNKLHYPIMEYYTPTTSSENMRDFATTLKNKFRSKHYFSKHPQRGYLPVQSVLEADYSETPASSPMWPHADTHSRIEHFASRLAEMESQNCSFFNDSLSPDDSIDEDQYLLRHSSPITDREPAFGQQAPCSVATESKGELQKILAHLEDENRILQGELRRLKWQHEEAAEAPSLADGSTEAATDHRNEELLAEARILRQHKSRLETRMQILEDHNKQLESQLQRLRELLLQPPTESDGSGSAGSSLASSPQQSEGSHPREKGQTTPDTEAADDVGSKSQDVSLCLEDIMEKLRHAFPSVRSSDVTANTLLAS

SEQ ID NO: 26377 - protein, 578 aa, Homo sapiens
  Payload ID: 5195
  Gene Symbol: DYTN
  Gene Name: dystrotelin
  Uniprot ID: A2CJ06
  ENSP ID: ENSP00000396593
MDPDKQDALNSIENSIYRTAFKLQSVQTLCQLDLIDSSLIQQVLLRPSFWEARKHSLSVQQLSQALQELFQKAREENPGQVHPRAPELTLSLLTTMYNSKGTGFLQLMPAAAALITLSGDSPLSKYRALFQLYAENSRGGYDSGPRMTRRVLRKLLTDLQQIPTFVGESRALCPVESATRSCFQGVLSPAIKEEKFLSWVQSEPPILLWLPTCHRLSAAERVTHPARCTLCRTFPITGLRYRCLKCLNFDICQMCFLSGLHSKSHQKSHPVIEHCIQMSAMQNTKLLFRTLRNNLLQGRCRKKEAARRQQLLDQVNPKGVPHHAQARLLKKQLNQYKDKLQAIYTSQEERICRFETRIHKLKTNQDSLWTKLQQIRRDLQARLQPPGPSSSSFQNVGNKVDHSSTEKVPKGGDYLQIKNATEDASTGEPLPKLDEVDRSHRSHTNAEHALRNPESPETTLHSTRAQSQTQKMPQKVISALPSYQEGLKQDIPKMVPAEMSSPALAAVEKKEAGNIKERKDELEEEELQELLSKLMDAFNLETPSGPESSVNMDLYSGAQRVCRAFSALVDQIALPNLK

SEQ ID NO: 26378 - protein, 2414 aa, Homo sapiens
  Payload ID: 5196
  Gene Symbol: EP300
  Gene Name: E1A binding protein p300
  Uniprot ID: Q09472
  ENSP ID: ENSP00000263253
MAENVVEPGPPSAKRPKLSSPALSASASDGTDFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGMNAGMNPGMLAAGNGQGIMPNQVMNGSIGAGRGRQNMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQPILTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTPPSIGAQQPPATTIPAPVPTPPAMPPGPQSQALHPPPRQTPTPPTTQLPQQVQPSLPAAPSADQPQQQPRSQQSTAASVPTPTAPLLPPQPATPLSQPAVSIEGQVSNPPSTSSTEVNSQAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 26379 - protein, 133 aa, Homo sapiens
  Payload ID: 5196
  Gene Symbol: EP300
  Gene Name: E1A binding protein p300
  ENSP ID: ENSP00000488981
AEYYHLLAEKIYKIQKELEEKRRTRLQKQNMLPNAAGMVPVSMNPGPNMGQPQPGMTSSLNQFGQMSMAQPPIVPRQTPPLQHHGQLAQPGALNPPMGYGPRMQQPSNQGQFLPQTQFPSQGMNVTNIPLAPS

SEQ ID NO: 26380 - protein, 187 aa, Homo sapiens
  Payload ID: 5196
  Gene Symbol: EP300
  Gene Name: E1A binding protein p300
  ENSP ID: ENSP00000489397
  MOD_RES (1)..(1): Any amino acid
XVNQMPTQPQVQAKNQQNQQPGQSPQGMRPMSNMSASPMGVNGGVGVQTPSLLSDSMLHSAINSQNVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITP

SEQ ID NO: 26381 - protein, 374 aa, Homo sapiens
  Payload ID: 5197
  Gene Symbol: EP400
  Gene Name: E1A binding protein p400
  ENSP ID: ENSP00000330620
  MOD_RES (1)..(1): Any amino acid
XQQQQQTTTTSQVQVPQIQGQAQSPAQIKAVGKLTPEHLIKMQKQKLQMPPQPPPPQAQSAPPQPTAQVQVQTSQPPQQQSPQLTTVTAPRPGALLTGTTVANLQVARLLQAQGQMQTQAPQPAQVALAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 26382 - protein, 826 aa, Homo sapiens
  Payload ID: 5197
  Gene Symbol: EP400
  Gene Name: E1A binding protein p400
  ENSP ID: ENSP00000331737
MHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGGFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKKKHYAPLQAYLRQNDLDIEEEEEEEEEEEEKSEVINDEQALAGSLVAGAGSTVETDLFKRQQAMPSTGMAGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEK

SEQ ID NO: 26383 - protein, 985 aa, Homo sapiens
  Payload ID: 5197
  Gene Symbol: EP400
  Gene Name: E1A binding protein p400
  ENSP ID: ENSP00000333602
MHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGGFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKKKHYAPLQAYLRQNDLDIEEEEEEEEEEEEKSEVINDEVKVVTGKDGQTGTPVAIATQLPPKVSAAFSSQQQPFQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEGRLLLPY

SEQ ID NO: 26384 - protein, 3123 aa, Homo sapiens
  Payload ID: 5197
  Gene Symbol: EP400
  Gene Name: E1A binding protein p400
  Uniprot ID: Q96L91
  ENSP ID: ENSP00000374212
MHHGTGPQNVQHQLQRSRACPGSEGEEQPAHPNPPPSPAAPFAPSASPSAPQSPSYQIQQLMNRSPATGQNVNITLQSVGPVVGGNQQITLAPLPLPSPTSPGFQFSAQPRRFEHGSPSYIQVTSPLSQQVQTQSPTQPSPGPGQALQNVRAGAPGPGLGLCSSSPTGGFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHYQEMQALKEVFKEYLIELFFLQHFQGNMMDFLAFKKKHYAPLQAYLRQNDLDIEEEEEEEEEEEEKSEVINDEQQALAGSLVAGAGSTVETDLFKRQQAMPSTGMAEQSKRPRLEVGHQGVVFQHPGADAGVPLQQLMPTAQGGMPPTPQAAQLAGQRQSQQQYDPSTGPPVQNAASLHTPLPQLPGRLPPAGVPTAALSSALQFAQQPQVVEAQTQLQIPVKTQQPNVPIPAPPSSQLPIPPSQPAQLALHVPTPGKVQVQASQLSSLPQMVASTRLPVDPAPPCPRPLPTSSTSSLAPVSGSGPGPSPARSSPVNRPSSATNKALSPVTSRTPGVVASAPTKPQSPAQNATSSQDSSQDTLTEQITLENQVHQRIAELRKAGLWSQRRLPKLQEAPRPKSHWDYLLEEMQWMATDFAQERRWKVAAAKKLVRTVVRHHEEKQLREERGKKEEQSRLRRIAASTAREIECFWSNIEQVVEIKLRVELEEKRKKALNLQKVSRRGKELRPKGFDALQESSLDSGMSGRKRKASISLTDDEVDDEEETIEEEEANEGVVDHQTELSNLAKEAELPLLDLMKLYEGAFLPSSQWPRPKPDGEDTSGEEDADDCPGDRESRKDLVLIDSLFIMDQFKAAERMNIGKPNAKDIADVTAVAEAILPKGSARVTTSVKFNAPSLLYGALRDYQKIGLDWLAKLYRKNLNGILADEAGLGKTVQIIAFFAHLACNEGNWGPHLVVVRSCNILKWELELKRWCPGLKILSYIGSHRELKAKRQEWAEPNSFHVCITSYTQFFRGLTAFTRVRWKCLVIDEMQRVKGMTERHWEAVFTLQSQQRLLLIDSPLHNTFLELWTMVHFLVPGISRPYLSSPLRAPSEESQDYYHKVVIRLHRVTQPFILRRTKRDVEKQLTKKYEHVLKCRLSNRQKALYEDVILQPGTQEALKSGHFVNVLSILVRLQRICNHPGLVEPRHPGSSYVAGPLEYPSASLILKALERDFWKEADLSMFDLIGLENKITRHEAELLSKKKIPRKLMEEISTSAAPAARPAAAKLKASRLFQPVQYGQKPEGRTVAFPSTHPPRTAAPTTASAAPQGPLRGRPPIATFSANPEAKAAAAPFQTSQASASAPRHQPASASSTAASPAHPAKLRAQTTAQASTPGQPPPQPQAPSHAAGQSALPQRLVLPSQAQARLPSGEVVKIAQLASITGPQSRVAQPETPVTLQFQGSKFTLSHSQLRQLTAGQPLQLQGSVLQIVSAPGQPYLRAPGPVVMQTVSQAGAVHGALGSKPPAGGPSPAPLTPQVGVPGRVAVNALAVGEPGTASKPASPIGGPTQEEKTRLLKERLDQIYLVNERRCSQAPVYGRDLLRICALPSHGRVQWRGSLDGRRGKEAGPAHSYTSSSESPSELMLTLCRCGESLQDVIDRVAFVIPPVVAAPPSLRVPRPPPLYSHRMRILRQGLREHAAPYFQQLRQTTAPRLLQFPELRLVQFDSGKLEALAILLQKLKSEGRRVLILSQMILMLDILEMFLNFHYLTYVRIDENASSEQRQELMRSFNRDRRIFCAILSTHSRTTGINLVEADTVVFYDNDLNPVMDAKAQEWCDRIGRCKDIHIYRLVSGNSIEEKLLKNGTKDLIREVAAQGNDYSMAFLTQRTIQELFEVYSPMDDAGFPVKAEEFVVLSQEPSVTETIAPKIARPFIEALKSIEYLEEDAQKSAQEGVLGPHTDALSSDSENMPCDEEPSQLEELADFMEQLTPIEKYALNYLELFHTSIEQEKERNSEDAVMTAVRAWEFWNLKTLQEREARLRLEQEEAELLTYTREDAYSMEYVYEDVDGQTEVMPLWTPPTPPQDDSDIYLDSVMCLMYEATPIPEAKLPPVYVRKERKRHKTDPSAAGRKKKQRHGEAVVPPRSLFDRATPGLLKIRREGKEQKKNILLKQQVPFAKPLPTFAKPTAEPGQDNPEWLISEDWALLQAVKQLLELPLNLTIVSPAHTPNWDLVSDVVNSCSRIYRSSKQCRNRYENVIIPREEGKSKNNRPLRTSQIYAQDENATHTQLYTSHFDLMKMTAGKRSPPIKPLLGMNPFQKNPKHASVLAESGINYDKPLPPIQVASLRAERIAKEKKALADQQKAQQPAVAQPPPPQPQPPPPPQQPPPPLPQPQAAGSQPPAGPPAVQPQPQPQPQTQPQPVQAPAKAQPAITTGGSAAVLAGTIKTSVTGTSMPTGAVSGNVIVNTIAGVPAATFQSINKRLASPVAPGALTTPGGSAPAQVVHTQPPPRAVGSPATATPDLVSMATTQGVRAVTSVTASAVVTTNLTPVQTPARSLVPQVSQATGVQLPGKTITPAHFQLLRQQQQQQQQQQQQQQQQQQQQQQQQQQQQQTTTTSQVQVPQIQGQAQSPAQIKAVGKLTPEHLIKMQKQKLQMPPQPPPPQAQSAPPQPTAQVQVQTSQPPQQQSPQLTTVTAPRPGALLTGTTVANLQVARLTRVPTSQLQAQGQMQTQAPQPAQVALAKPPVVSVPAAVVSSPGVTTLPMNVAGISVAIGQPQKAAGQTVVAQPVHMQQLLKLKQQAVQQQKAIQPQAAQGPAAVQQKITAQQITTPGAQQKVAYAAQPALKTQFLTTPISQAQKLAGAQQVQTQIQVAKLPQVVQQQTPVASIQQVASASQQASPQTVALTQATAAGQQVQMIPAVTATAQVVQQKLIQQQVVTTASAPLQTPGAPNPAQVPASSDSPSQQPKLQMRVPAVRLKTPTKPPCQ

SEQ ID NO: 26385 - protein, 3123 aa, Homo sapiens; identical to SEQ ID NO: 26384
  Payload ID: 5197
  Gene Symbol: EP400
  Gene Name: E1A binding protein p400
  Uniprot ID: Q96L91
  ENSP ID: ENSP00000374213

SEQ ID NO: 26386 - protein, 437 aa, Homo sapiens
  Payload ID: 5198
  Gene Symbol: E2F1
  Gene Name: E2F transcription factor 1
  Uniprot ID: Q01094
  ENSP ID: ENSP00000345571
MALAGAPAGGPCAPALEALLGAGALRLLDSSQIVIISAAQDASAPPAPTGPAAPAAGPCDPDLLLFATPQAPRPTPSAPRPALGRPPVKRRLDLETDHQYLAESSGPARGRGRHPGKGVKSPGEKSRYETSLNLTTKRFLELLSHSADGVVDLNWAAEVLKVQKRRIYDITNVLEGIQLIAKKSKNHIQWLGSHTTVGVGGRLEGLTQDLRQLQESEQQLDHLMNICTTQLRLLSEDTDSQRLAYVTCQDLRSIADPAEQMVMVIKAPPETQLQAVDSSENFQISLKSKQGPIDVFLCPEETVGGISPGKTPSQEVTSEEENRATDSATIVSPPPSSPPSSLTTDPSQSLLSLEQEPLLSRMGSLRAPVDEDRLSPLVAADSLLEHVREDFSGLLPEEFISLSPPHEALDYHFGLEEGEGIRDLFDCDFGDLTPLDF

SEQ ID NO: 26387 - protein, 437 aa, Homo sapiens
  Payload ID: 5199
  Gene Symbol: E2F2
  Gene Name: E2F transcription factor 2
  Uniprot ID: Q14209
  ENSP ID: ENSP00000355249
MLQGPRALASAAGQTPKVVPAMSPTELWPSGLSSPQLCPATATYYTPLYPQTAPPAAAPGTCLDATPHGPEGQVVRCLPAGRLPAKRKLDLEGIGRPVVPEFPTPKGKCIRVDGLPSPKTPKSPGEKTRYDTSLGLLTKKFIYLLSESEDGVLDLNWAAEVLDVQKRRIYDITNVLEGIQLIRKKAKNNIQWVGRGMFEDPTRPGKQQQLGQELKELMNTEQALDQLIQSCSLSFKHLTEDKANKRLAYVTYQDIRAVGNFKEQTVIAVKAPPQTRLEVPDRTEDNLQIYLKSTQGPIEVYLCPEEVQEPDSPSEEPLPSTSTLCPSPDSAQPSSSTDPSIMEPTASSVPAPAPTPQQAPPPPSLVPLEATDSLLELPHPLLQQTEDQFLSPTLACSSPLISFSPSLDQDDYLWGLEAGEGISDLFDSYDLGDLLIN

SEQ ID NO: 26388 - protein, 437 aa, Homo sapiens; identical to SEQ ID NO: 26387
  Payload ID: 5199
  Gene Symbol: E2F2
  Gene Name: E2F transcription factor 2
  ENSP ID: ENSP00000489612

SEQ ID NO: 26389 - protein, 465 aa, Homo sapiens
  Payload ID: 5200
  Gene Symbol: E2F3
  Gene Name: E2F transcription factor 3
  Uniprot ID: O00716
  ENSP ID: ENSP00000262904
MRKGIQPALEQYLVTAGGGEGAAVVAAAAAASMDKRALLASPGFAAAAAAAAAPGAYIQILTTNTSTTSCSSSLQSGAVAAGPLLPSAPGAEQTAGSLLYTTPHGPSSRAGLLQQPPALGRGGSGGGGGPPAKRRLELGESGHQYLSDGLKTPKGKGRAALRSPDSPKTPKSPSEKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 26390 - protein, 334 aa, Homo sapiens
  Payload ID: 5200
  Gene Symbol: E2F3
  Gene Name: E2F transcription factor 3
  Uniprot ID: O00716
  ENSP ID: ENSP00000443418
MPLQQQAKRRLELGESGHQYLSDGLKTPKGKGRAALRSPDSPKKKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 26391 - protein, 128 aa, Homo sapiens
  Payload ID: 5200
  Gene Symbol: E2F3
  Gene Name: E2F transcription factor 3
  ENSP ID: ENSP00000483249
MDKRALLASPGFAAPPAKRRLELGESGHQYLSDGLKTPKGKGRAALRSPDSPKKKTRYDTSLGLLTKKFIQLLSQSPDGVLDLNKAAEVLKVQKRRIYDITNVLEGISDLFDAYDLEKLPLVEDFMCS

SEQ ID NO: 26392 - protein, 413 aa, Homo sapiens
  Payload ID: 5201
  Gene Symbol: E2F4
  Gene Name: E2F transcription factor 4, p107/p130-binding
  Uniprot ID: Q16254
  ENSP ID: ENSP00000368686
MAEAGPQAPPPPGTPSRHEKSLGLLTTKFVSLLQEAKDGVLDLKLAADTLAVRQKRRIYDITNVLEGIGLIEKKSKNSIQWKGVGPGCNTREIADKLIELKAEIEELQQREQELDQHKVWVQQSIRNVTEDVQNSCLAYVTHEDICRCFAGDTLLAIRAPSGTSLEVPIPEGLNGQKKYQIHLKSVSGPIEVLLVNKEAWSSPPVAVPVPPPEDLLQSPSAVSTPPPLPKPALAQSQEASRPNSPQLTPTAVPGSAEVQGMAGPAAEITVSGGPGTDSKDSGELSSLPLGPTTLDTRPLQSSALLDSSSSSSSSSSSSSNSNSSSSSGPNPSTSFEPIKADPTGVLELPKELSEIFDPTRECMSSELLEELMSSEVFAPLLRLSPPPGDHDYIYNLDESEGVCDLFDVPVLNL

SEQ ID NO: 26393 - protein, 81 aa, Homo sapiens
  Payload ID: 5201
  Gene Symbol: E2F4
  Gene Name: E2F transcription factor 4, p107/p130-binding
  ENSP ID: ENSP00000454477
MAEAGPQAPPPPGTPSRHEKSLGLLTTKFVSLLQEAKDGVLDLKLAADTLAVRQKRRIYDITNVLEGVWGLAAIPGRLLTN

SEQ ID NO: 26394 - protein, 121 aa, Homo sapiens
  Payload ID: 5201
  Gene Symbol: E2F4
  Gene Name: E2F transcription factor 4, p107/p130-binding
  ENSP ID: ENSP00000457239
MAEAGPQAPPPPGTPSRHEKSLGLLTTKFVSLLQEAKDGVLDLKLAADTLAVRQKRRIYDITNVLEGIGLIEKKSKNSIQWKRYPLGHPGPIRHQPGGAHPRGSQWAEEVPDSPEECEWSH

SEQ ID NO: 26395 - protein, 145 aa, Homo sapiens
  Payload ID: 5201
  Gene Symbol: E2F4
  Gene Name: E2F transcription factor 4, p107/p130-binding
  ENSP ID: ENSP00000458082
MAEAGPQAPPPPGTPSRHEKSLGLLTTKFVSLLQEAKDGVLDLKLAADTLAVRQKRRIYDITNVLEGIGLIEKKSKNSIQWNLPSVTIGHQPFSLTLTLWPTSLMRTSADALLEIPSWPSGPHQAPAWRCPSQRVSMGRRSTRFT

SEQ ID NO: 26396 - protein, 144 aa, Homo sapiens
  Payload ID: 5201
  Gene Symbol: E2F4
  Gene Name: E2F transcription factor 4, p107/p130-binding
  ENSP ID: ENSP00000458706
  MOD_RES (1)..(1): Any amino acid
XMAGPAAEITVSGGPGTDSKDSGELSSLPLGPTTLDTRPLQSSALLDSSSSSSSSSSSSSNSNSSSSSGPNPSTSFEPIKADPTGVLELPKELSEIFDPTRECMSSELLEELMSSEGTCPVWLGPRLSDLGVAWGPLPPDPYRA

SEQ ID NO: 26397 - protein, 249 aa, Homo sapiens
  Payload ID: 5202
  Gene Symbol: E2F5
  Gene Name: E2F transcription factor 5, p130-binding
  ENSP ID: ENSP00000256117
  MOD_RES (1)..(1): Any amino acid
XLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDGK

SEQ ID NO: 26398 - protein, 346 aa, Homo sapiens
  Payload ID: 5202
  Gene Symbol: E2F5
  Gene Name: E2F transcription factor 5, p130-binding
  Uniprot ID: Q15329
  ENSP ID: ENSP00000398124
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 26399 - protein, 345 aa, Homo sapiens
  Payload ID: 5202
  Gene Symbol: E2F5
  Gene Name: E2F transcription factor 5, p130-binding
  Uniprot ID: Q15329
  ENSP ID: ENSP00000414312
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSGSISGDIIDELMSSDVFPLLRLSPTPADDYNFNLDDNEGVCDLFDVQILNY

SEQ ID NO: 26400 - protein, 173 aa, Homo sapiens
  Payload ID: 5202
  Gene Symbol: E2F5
  Gene Name: E2F transcription factor 5, p130-binding
  ENSP ID: ENSP00000428606
MKTSVIALMVSDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 26401 - protein, 185 aa, Homo sapiens
  Payload ID: 5202
  Gene Symbol: E2F5
  Gene Name: E2F transcription factor 5, p130-binding
  Uniprot ID: Q15329
  ENSP ID: ENSP00000429120
MDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 26402 - protein, 182 aa, Homo sapiens
  Payload ID: 5202
  Gene Symbol: E2F5
  Gene Name: E2F transcription factor 5, p130-binding
  ENSP ID: ENSP00000429669
SYDSTFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 26403 - protein, 130 aa, Homo sapiens
  Payload ID: 5202
  Gene Symbol: E2F5
  Gene Name: E2F transcription factor 5, p130-binding
  ENSP ID: ENSP00000430461
  MOD_RES (1)..(1): Any amino acid
XNKESSSSKPVVFPVPPPDDLTQPSSQSLTPVTPQKSSMATQNLPEQHVSERSQALQQTSATDISSAGSISGDIIDELMSSDGGKLKDTTGHQKQVGQGLITCLIFLLPLNCLYFCMSFYPNRRSLPLVK

SEQ ID NO: 26404 - protein, 249 aa, Homo sapiens
  Payload ID: 5203
  Gene Symbol: E2F6
  Gene Name: E2F transcription factor 6
  Uniprot ID: O75461
  ENSP ID: ENSP00000302159
MNPSPSKIRINLEDNVQYVSMRKALKVKRPRFDVSLVYLTRKFMDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 26405 - protein, 281 aa, Homo sapiens
  Payload ID: 5203
  Gene Symbol: E2F6
  Gene Name: E2F transcription factor 6
  Uniprot ID: O75461
  ENSP ID: ENSP00000370936
MSQQRPARKLPSLLLDPTEETVRRRCRDPINVEGLLPSKIRINLEDNVQYVSMRKALKVKRPRFDVSLVYLTRKFMDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 26406 - protein, 38 aa, Homo sapiens
  Payload ID: 5203
  Gene Symbol: E2F6
  Gene Name: E2F transcription factor 6
  ENSP ID: ENSP00000389113
MSQQRPARKLPSLLLDPTEETVRRRCRDPINVEGLLKL

SEQ ID NO: 26407 - protein, 50 aa, Homo sapiens
  Payload ID: 5203
  Gene Symbol: E2F6
  Gene Name: E2F transcription factor 6
  ENSP ID: ENSP00000403449
MSQQRPARKLPSLLLDPTEETVRRRCRDPINVEGLLLFIQANLACWARLS

SEQ ID NO: 26408 - protein, 55 aa, Homo sapiens
  Payload ID: 5203
  Gene Symbol: E2F6
  Gene Name: E2F transcription factor 6
  ENSP ID: ENSP00000406891
MSQQRPARKLPSLLLDPTEETVRRRCRDPINVEGLLPSKIRINLEDNVQYVSMRM

SEQ ID NO: 26409 - protein, 63 aa, Homo sapiens
  Payload ID: 5203
  Gene Symbol: E2F6
  Gene Name: E2F transcription factor 6
  ENSP ID: ENSP00000407650
MSQQRPARKLPSLLLDPTEETVRRRCRDPINVEGLLPSKIRINLEDNVQYVSMRNLLPGVFLT

SEQ ID NO: 26410 - protein, 50 aa, Homo sapiens; identical to SEQ ID NO: 26407
  Payload ID: 5203
  Gene Symbol: E2F6
  Gene Name: E2F transcription factor 6
  ENSP ID: ENSP00000413678

SEQ ID NO: 26411 - protein, 206 aa, Homo sapiens
  Payload ID: 5203
  Gene Symbol: E2F6
  Gene Name: E2F transcription factor 6
  Uniprot ID: O75461
  ENSP ID: ENSP00000438864
MDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 26412 - protein, 206 aa, Homo sapiens; identical to SEQ ID NO: 26411
  Payload ID: 5203
  Gene Symbol: E2F6
  Gene Name: E2F transcription factor 6
  Uniprot ID: O75461
  ENSP ID: ENSP00000446315

SEQ ID NO: 26413 - protein, 911 aa, Homo sapiens
  Payload ID: 5204
  Gene Symbol: E2F7
  Gene Name: E2F transcription factor 7
  Uniprot ID: Q96AV8
  ENSP ID: ENSP00000323246
MEVNCLTLKDLISPRQPRLDFAVEDGENAQKENIFVDRSRMAPKTPIKNEPIDLSKQKKFTPERNPITPVKFVDRQQAEPWTPTANLKMLISAASPDIRDREKKKGLFRPIENKDDAFTDSLQLDVVGDSAVDEFEKQRPSRKQKSLGLLCQKFLARYPSYPLSTEKTTISLDEVAVSLGVERRRIYDIVNVLESLHLVSRVAKNQYGWHGRHSLPKTLRNLQRLGEEQKYEEQMAYLQQKELDLIDYKFGERKKDGDPDSQEQQLLDFSEPDCPSSSANSRKDKSLRIMSQKFVMLFLVSKTKIVTLDVAAKILIEESQDAPDHSKFKTKVRRLYDIANVLTSLALIKKVHVTEERGRKPAFKWIGPVDFSSSDEELVDVSASVLPELKRETYGQIQVCAKQKLARHGSFNTVQASERIQRKVNSEPSSPYREEQGSGGYSLEIGSLAAVYRQKIEDNSQGKAFASKRVVPPSSSLDPVAPFPVLSVDPEYCVNPLAHPVFSVAQTDLQAFSMQNGLNGQVDVSLASAASAVESLKPALLAGQPLVYVPSASLFMLYGSLQEGPASGSGSERDDRSSEAPATVELSSAPSAQKRLCEERKPQEEDEPATKRQSREYEDGPLSLVMPKKPSDSTDLASPKTMGNRASIPLKDIHVNGQLPAAEEISGKATANSLVSSEWGNPSRNTDVEKPSKENESTKEPSLLQYLCVQSPAGLNGFNVLLSGSQTPPTVGPSSGQLPSFSVPCMVLPSPPLGPFPVLYSPAMPGPVSSTLGALPNTGPVNFSLPGLGSIAQLLVGPTAVVNPKSSTLPSADPQLQSQPSLNLSPVMSRSHSVVQQPESPVYVGHPVSVVKLHQSPVPVTPKSIQRTHRETFFKTPGSLGDPVLKRRERNQSRNTSSAQRRLEIPSGGAD

SEQ ID NO: 26414 - protein, 728 aa, Homo sapiens
  Payload ID: 5204
  Gene Symbol: E2F7
  Gene Name: E2F transcription factor 7
  Uniprot ID: Q96AV8
  ENSP ID: ENSP00000393639
MEVNCLTLKDLISPRQPRLDFAVEDGENAQKENIFVDRSRMAPKTPIKNEPIDLSKQKKFTPERNPITPVKFVDRQQAEPWTPTANLKMLISAASPDIRDREKKKGLFRPIENKDDAFTDSLQLDVVGDSAVDEFEKQRPSRKQKSLGLLCQKFLARYPSYPLSTEKTTISLDEVAVSLGVERRRIYDIVNVLESLHLVSRVAKNQYGWHGRHSLPKTLRNLQRLGEEQKYEEQMAYLQQKELDLIDYKFGERKKDGDPDSQEQQLLDFSEPDCPSSSANSRKDKSLRIMSQKFVMLFLVSKTKIVTLDVAAKILIEESQDAPDHSKFKTKVRRLYDIANVLTSLALIKKVHVTEERGRKPAFKWIGPVDFSSSDEELVDVSASVLPELKRETYGQIQVCAKQKLARHGSFNTVQASERIQRKVNSEPSSPYREEQGSGGYSLEIGSLAAVYRQKIEDNSQGKAFASKRVVPPSSSLDPVAPFPVLSVDPEYCVNPLAHPVFSVAQTDLQAFSMQNGLNGQVDVSLASAASAVESLKPALLAGQPLVYVPSASLFMLYGSLQEGPASGSGSERDDRSSEAPATVELSSAPSAQKRLCEERKPQEEDEPATKRQSREYEDGPLSLVMPKKPSDSTDLASPKTMGNRASIPLKDIHVNGQLPAAEEISGKATANSLVSSEWGNPSRNTDVEKPSKENESTKEPSLLQYLCVQSPAVTSSSDPQEHPTHTS

SEQ ID NO: 26415 - protein, 208 aa, Homo sapiens
  Payload ID: 5204
  Gene Symbol: E2F7
  Gene Name: E2F transcription factor 7
  ENSP ID: ENSP00000447963
DVVGDSAVDEFEKQRPSRKQKSLGLLCQKFLARYPSYPLSTEKTTISLDEVAVSLGVERRRIYDIVNVLESLHLVSRVAKNQYGWHGRHSLPKTLRNLQRLGEEQKYEEQMAYLQQKELDLIDYKFGERKKDGDPDSQEQQLLDFSEPDCPSSSANSRKDKSLRIMSQKFVMLFLVSKTKIVTLDVAAKILIEESQDAPDHSKFKRWR

SEQ ID NO: 26416 - protein, 693 aa, Homo sapiens
  Payload ID: 5204
  Gene Symbol: E2F7
  Gene Name: E2F transcription factor 7
  ENSP ID: ENSP00000448245
MEVNCLTLKDLISPRQPRLDFAVEDGENAQKENIFVDRSRMAPKTPIKNEPIDLSKQKKFTPERNPITPVKFVDRQQAEPWTPTANLKMLISAASPDIRDREKKKGLFRPIENKDDAFTDSLQLDVVGDSAVDEFEKQRPSRKQKSLGLLCQKFLARYPSYPLSTEKTTISLDEVAVSLGVERRRIYDIVNVLESLHLVSRVAKNQYGWHGRHSLPKTLRNLQRLGEEQKYEEQMAYLQQKELDLIDYKFGERKKDGDPDSQEQQLLDFSEPDCPSSSANSRKDKSLRIMSQKFVMLFLVSKTKIVTLDVAAKILIEESQDAPDHSKFKTKVRRLYDIANVLTSLALIKKVHVTEERGRKPAFKWIGPVDFSSSDEELVDVSASVLPELKRETYGQIQVCAKQKLARHGSFNTVQASERIQRKVNSEPSSPYREEQGSGGYSLEIGSLAAVYRQKIEDNSQGKAFASKRVVPPSSSLDPVAPFPVLSVDPEYCVNPLAHPVFSVAQTDLQAFSMQNGLNGQVDVSLASAASAVESLKPALLAGQPLVYVPSASLFMLYGSLQEGPASGSGSERDDRSSEAPATVELSSAPSAQKRLCEERKPQEEDEPATKRQSREYEDGPLSLVMPKKPSDSTDLASPKTMGNRASIPLKDIHVNGQLPAAEEISGKATANSLVSSEWGNPSRNTDVEKPSK

SEQ ID NO: 26417 - protein, 115 aa, Homo sapiens
  Payload ID: 5204
  Gene Symbol: E2F7
  Gene Name: E2F transcription factor 7
  ENSP ID: ENSP00000449033
MEVNCLTLKDLISPRQPRLDFAVEDGENAQKENIFVDRSRMAPKTPIKNEPIDLSKQKKFTPERNPITPVKFVDRQQAEPWTPTANLKMLISAASPDIRDREKKKGLFRPIENKD

SEQ ID NO: 26418 - protein, 219 aa, Homo sapiens
  Payload ID: 5204
  Gene Symbol: E2F7
  Gene Name: E2F transcription factor 7
  ENSP ID: ENSP00000449284
  MOD_RES (1)..(1): Any amino acid
XLDVVGDSAVDEFEKQRPSRKQKSLGLLCQKFLARYPSYPLSTEKTTISLDEVAVSLGVERRRIYDIVNVLESLHLVSRVAKNQYGWHGRHSLPKTLRNLQRLGEEQKYEEQMAYLQQKELDLIDYKFGERKKDGDPDSQEQQLLDFSEPDCPSSSANSRKDKSLRIMSQKFVMLFLVSKTKIVTLDVAAKILIEESQDAPDHSKFKSKNLHLHQLTST

SEQ ID NO: 26419 - protein, 867 aa, Homo sapiens
  Payload ID: 5205
  Gene Symbol: E2F8
  Gene Name: E2F transcription factor 8
  Uniprot ID: A0AVK6
  ENSP ID: ENSP00000250024
MENEKENLFCEPHKRGLMKTPLKESTTANIVLAEIQPDFGPLTTPTKPKEGSQGEPWTPTANLKMLISAVSPEIRNRDQKRGLFDNRSGLPEAKDCIHEHLSGDEFEKSQPSRKEKSLGLLCHKFLARYPNYPNPAVNNDICLDEVAEELNVERRRIYDIVNVLESLHMVSRLAKNRYTWHGRHNLNKTLGTLKSIGEENKYAEQIMMIKKKEYEQEFDFIKSYSIEDHIIKSNTGPNGHPDMCFVELPGVEFRAASVNSRKDKSLRVMSQKFVMLFLVSTPQIVSLEVAAKILIGEDHVEDLDKSKFKTKIRRLYDIANVLSSLDLIKKVHVTEERGRKPAFKWTGPEISPNTSGSSPVIHFTPSDLEVRRSSKENCAKNLFSTRGKPNFTRHPSLIKLVKSIESDRRKINSAPSSPIKTNKAESSQNSAPFPSKMAQLAAICKMQLEEQSSESRQKVKVQLARSGPCKPVAPLDPPVNAEMELTAPSLIQPLGMVPLIPSPLSSAVPLILPQAPSGPSYAIYLQPTQAHQSVTPPQGLSPTVCTTHSSKATGSKDSTDATTEKAANDTSKASASTRPGSLLPAPERQGAKSRTREPAGERGSKRASMLEDSGSKKKFKEDLKGLENVSATLFPSGYLIPLTQCSSLGAESILSGKENSSALSPNHRIYSSPIAGVIPVTSSELTAVNFPSFHVTPLKLMVSPTSVAAVPVGNSPALASSHPVPIQNPSSAIVNFTLQHLGLISPNVQLSASPGSGIVPVSPRIESVNVAPENAGTQQGRATNYDSPVPGQSQPNGQSVAVTGAQQPVPVTPKGSQLVAESFFRTPGGPTKPTSSSCMDFEGANKTSLGTLFVPQRKLEVSTEDVH

SEQ ID NO: 26420 - protein, 867 aa, Homo sapiens; identical to SEQ ID NO: 26419
  Payload ID: 5205
  Gene Symbol: E2F8
  Gene Name: E2F transcription factor 8
  Uniprot ID: A0AVK6
  ENSP ID: ENSP00000434199

SEQ ID NO: 26421 - protein, 139 aa, Homo sapiens
  Payload ID: 5205
  Gene Symbol: E2F8
  Gene Name: E2F transcription factor 8
  ENSP ID: ENSP00000437326
MENEKENLFCEPHKRGLMKTPLKESTTANIVLAEIQPDFGPLTTPTKPKEGSQGEPWTPTANLKMLISAVSPEIRNRDQKRGLFDNRSGLPEAKDCIHEHLSGDEFEKSQPSRKEKSLGLLCHKFLARYPNYPNPAVNN

SEQ ID NO: 26422 - protein, 867 aa, Homo sapiens; identical to SEQ ID NO: 26419
  Payload ID: 5205
  Gene Symbol: E2F8
  Gene Name: E2F transcription factor 8
  Uniprot ID: A0AVK6
  ENSP ID: ENSP00000481103

SEQ ID NO: 26423 - protein, 285 aa, Homo sapiens
  Payload ID: 5206
  Gene Symbol: EAPP
  Gene Name: E2F-associated phosphoprotein
  Uniprot ID: Q56P03
  ENSP ID: ENSP00000250454
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAVQVTKKKKKKQHKIPTNDELLYDPEKDNRDQAWVDAQRRGYHGLGPQRSRQQQPVPNSDAVLNCPACMTTLCLDCQRHESYKTQYRAMFVMNCSINKEEVLRYKASENRKKRRVHKKMRSNREDAAEKAETDVEEIYHPVMCTECSTEVAVYDKDEVFHFFNVLASHS

SEQ ID NO: 26424 - protein, 205 aa, Homo sapiens
  Payload ID: 5206
  Gene Symbol: EAPP
  Gene Name: E2F-associated phosphoprotein
  ENSP ID: ENSP00000450908
MYASSEDEVDVLLHGTPDQKRKLIRECLTGESESSSEDEFEKEMEAELNSTMKTMEDKLSSLGTGSSSGNGKVATAPTRYYDDIYFDSDSEDEDRAVQVTKKKKKKQHKIPTNDELLYDPEKDNRDQAWVDAQRRGYHGLGPQRSRQQQPVPNSDAVLNCPACMTTLCLDCQRHESYKTQYRAMFVMNCSINKEEVLRYKASENR

SEQ ID NO: 26425 - protein, 109 aa, Homo sapiens
  Payload ID: 5206
  Gene Symbol: EAPP
  Gene Name: E2F-associated phosphoprotein
  ENSP ID: ENSP00000452439
MNRLPDDYDPYAVEEPSDEEPALSRWAPAPPWPPRIWVEAWLWSPPFVAPAEPTQTLAAREPVVPVTCAKPKGFPDGVAQSRGEAVPMSPVGRGIFRNHGGPRVNLQKQ

SEQ ID NO: 26426 - protein, 231 aa, Homo sapiens [sequence omitted]

SEQ ID NO: 26427 - protein, 784 aa, Homo sapiens
  Payload ID: 5207
  Gene Symbol: E4F1
  Gene Name: E4F transcription factor 1
  Uniprot ID: Q66K89
  ENSP ID: ENSP00000301727
MEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPRQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSSEGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVLVEFSSVVADTQEYIIEATADDAETSEATEIIEGTQTEVDSHIMKVVQQIVHQASAGHQIIVQNVTMDEETALGPEAAAADTITIATPESLTEQVAMTLASAISEGTVLAARAGTSGTEQATVTMVSSEDIEILEHAGELVIASPEGQLEVQTVIV

SEQ ID NO: 26428 - protein, 272 aa, Homo sapiens
  Payload ID: 5207
  Gene Symbol: E4F1
  Gene Name: E4F transcription factor 1
  ENSP ID: ENSP00000454652
MARAAGSTDPPRPRHLADLAGPSQPSTKPPDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPRQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARA

SEQ ID NO: 26429 - protein, 208 aa, Homo sapiens
  Payload ID: 5207
  Gene Symbol: E4F1
  Gene Name: E4F transcription factor 1
  ENSP ID: ENSP00000456005
  MOD_RES (1)..(1): Any amino acid
XEGAMAVRVTAAHTAEAQAEAGREAGEGAVAAVAAALAPSGFLGLPAPFSEEGLEEKPDGALAAQPPPSQALLTAGSLQMRTMCTDAAAARQSSPPWRILFSTRFRRPASGPLRRPCLPPLPPQRCWARRWCRQHQAQRSPSLWPTSWWRRPLWQQTSATHLTLLVVGTSKRSSWLLRRSWETVRWPRPRAAPASRGWGSQGRVSRPR

SEQ ID NO: 26430 - protein, 607 aa, Homo sapiens
  Payload ID: 5207
  Gene Symbol: E4F1
  Gene Name: E4F transcription factor 1
  ENSP ID: ENSP00000456760
MEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPRQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSSEGSRENLLHQFCSRGFREKGSLVRHVRHHTGEKPFKCYKCGRGFAEHGTLNRHLRTKGGCLLEVEELLVSEDSPAAATTVLTEDPHTVLVEFSSVVADTQEYIIEATADDAETSEATEIIEGTQTEVDSHIMKVVQQIVHQASAGHQIIVQNVTMDEETALGPEAAAADTITIATPESLTEQVAMTLASAISEGTVLAARAGTSGTEQATVTMVSSEDIEILEHAGELVIASPEGQLEVQTVIV

SEQ ID NO: 26431 - protein, 654 aa, Homo sapiens
  Payload ID: 5207
  Gene Symbol: E4F1
  Gene Name: E4F transcription factor 1
  ENSP ID: ENSP00000457672
MEGAMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPRQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSSEGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKKHQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVPLRTMRRPVRPRRSSRAPRQRWTATS

SEQ ID NO: 26432 - protein, 619 aa, Homo sapiens
  Payload ID: 5208
  Gene Symbol: ELF1
  Gene Name: E74-like factor 1 (ets domain transcription factor)
  Uniprot ID: P32519
  ENSP ID: ENSP00000239882
MAAVVQQNDLVFEFASNVMEDERQLGDPAIFPAVIVEHVPGADILNSYAGLACVEEPNDMITESSLDVAEEEIIDDDDDDITLTVEASCHDGDETIETIEAAEALLNMDSPGPMLDEKRINNNIFSSPEDDMVVAPVTHVSVTLDGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLEPNSF

SEQ ID NO: 26433 - protein, 24 aa, Homo sapiens
  Payload ID: 5208
  Gene Symbol: ELF1
  Gene Name: E74-like factor 1 (ets domain transcription factor)
  ENSP ID: ENSP00000384135
MAAVVQQNDLVFEFASNVMEDERQ

SEQ ID NO: 26434 - protein, 361 aa, Homo sapiens
  Payload ID: 5208
  Gene Symbol: ELF1
  Gene Name: E74-like factor 1 (ets domain transcription factor)
  ENSP ID: ENSP00000405580
MNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLEPNSF

SEQ ID NO: 26435 - protein, 595 aa, Homo sapiens
  Payload ID: 5208
  Gene Symbol: ELF1
  Gene Name: E74-like factor 1 (ets domain transcription factor)
  Uniprot ID: P32519
  ENSP ID: ENSP00000486912
MAAVVQQNDLVFEFASNVMEDERQLGDPAIFPAVIVEHVPGADILNSYAGLACVEEPNDMITESSLDVAEEEIIDDDDDDITLTVEASCHDGDETIETIEAAEALLNMDSPGPMLDEKRINGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLEPNSF

SEQ ID NO: 26436 - protein, 124 aa, Homo sapiens
  Payload ID: 5208
  Gene Symbol: ELF1
  Gene Name: E74-like factor 1 (ets domain transcription factor)
  ENSP ID: ENSP00000487240
MAAVVQQNDLVFEFASNVMEDERQLGDPAIFPAVIVEHVPGADILNSYAGLACVEEPNDMITESSLDVAEEEIIDDDDDDITLTVETGFLHVGQSQTPDLKQSACLGFPKCGITGMSHCASQVC

SEQ ID NO: 26437 - protein, 615 aa, Homo sapiens
  Payload ID: 5208
  Gene Symbol: ELF1
  Gene Name: E74-like factor 1 (ets domain transcription factor)
  ENSP ID: ENSP00000489586
MAAVVQQNDLVFEFASNVMEDERQLGDPAIFPAVIVEHVPGADILNSYAGLACVEEPNDMITESSLDVAEEEIIDDDDDDITLTVEASCHDGDETIETIEAAEALLNMDSPGPMLDEKRINNNIFSSPEDDMVVAPVTHVSVTLDGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYINDEDPSSSIESSDPSLSSSATSNRNQTSRSRVSSSPGVKGGATTVLKPGNSKAAKPKDPVEVAQPSEVLRTVQPTQSPYPTQLFRTVHVVQPVQAVPEGEAARTSTMQDETLNSSVQSIRTIQAPTQVPVVVSPRNQQLHTVTLQTVPLTTVIASTDPSAGTGSQKFILQAIPSSQPMTVLKENVMLQSQKAGSPPSIVLGPAQVQQVLTSNVQTICNGTVSVASSPSFSATAPVVTFSPRSSQLVAHPPGTVITSVIKTQETKTLTQEVEKKESEDHLKENTEKTEQQPQPYVMVVSSSNGFTSQVAMKQNELLE

SEQ ID NO: 26438 - protein, 533 aa, Homo sapiens
  Payload ID: 5209
  Gene Symbol: ELF2
  Gene Name: E74-like factor 2 (ets domain transcription factor)
  Uniprot ID: Q15723
  ENSP ID: ENSP00000351458
MATSLHEGPTNQLDLLIRAVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 26439 - protein, 504 aa, Homo sapiens
  Payload ID: 5209
  Gene Symbol: ELF2
  Gene Name: E74-like factor 2 (ets domain transcription factor)
  Uniprot ID: Q15723
  ENSP ID: ENSP00000368867
MATSLHEGPTNQLDLLIRAVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 26440 - protein, 593 aa, Homo sapiens
  Payload ID: 5209
  Gene Symbol: ELF2
  Gene Name: E74-like factor 2 (ets domain transcription factor)
  Uniprot ID: Q15723
  ENSP ID: ENSP00000368868
MTSAVVDSGGTILELSSNGVENQEESEKVSEYPAVIVEPVPSARLEQGYAAQVLVYDDETYMMQDVAEEQEVETENVETVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 26441 - protein, 581 aa, Homo sapiens
  Payload ID: 5209
  Gene Symbol: ELF2
  Gene Name: E74-like factor 2 (ets domain transcription factor)
  Uniprot ID: Q15723
  ENSP ID: ENSP00000377782
MTSAVVDSGGTILELSSNGVENQEESEKVSEYPAVIVEPVPSARLEQGYAAQVLVYDDETYMMQDVAEEQEVETENVETVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 26442 - protein, 245 aa, Homo sapiens
  Payload ID: 5209
  Gene Symbol: ELF2
  Gene Name: E74-like factor 2 (ets domain transcription factor)
  ENSP ID: ENSP00000397796
MATSLHEGPTNQLDLLIRAVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAA

SEQ ID NO: 26443 - protein, 93 aa, Homo sapiens
  Payload ID: 5209
  Gene Symbol: ELF2
  Gene Name: E74-like factor 2 (ets domain transcription factor)
  ENSP ID: ENSP00000421278
MTSAVVDSGGTILELSSNGVENQEESEKVSEYPAVIVEPVPSARLEQGYAAQVLVYDDETYMMQDVAEEQEVETENVETGGISLCHPGWSAVV

SEQ ID NO: 26444 - protein, 192 aa, Homo sapiens
  Payload ID: 5209
  Gene Symbol: ELF2
  Gene Name: E74-like factor 2 (ets domain transcription factor)
  ENSP ID: ENSP00000426087
MATSLHEGPTNQLDLLIRAVEASVHSSNAHCTDKTIEAAEALLHMESPTCLRDSRSPEFIHAAMRPDVITETVVEVSTEESEPMDTSPIPTSPDSHEPMKKKKGNTTYLWEFLLDLLQDKNTCPRYIKWTQREKGIFKLVDSKAVSKLWGKHKNKPDMNYETMGRALRYYYQRGILAKVEGQRLVYQFKDMP

SEQ ID NO: 26445 - protein, 521 aa, Homo sapiens
  Payload ID: 5209
  Gene Symbol: ELF2
  Gene Name: E74-like factor 2 (ets domain transcription factor)
  Uniprot ID: Q15723
  ENSP ID: ENSP00000426997
MATSLHEGPTNQLDLLIRAVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 26446 - protein, 371 aa, Homo sapiens
  Payload ID: 5210
  Gene Symbol: ELF3
  Gene Name: E74-like factor 3 (ets domain transcription factor, epithelial-specific )
  Uniprot ID: P78545
  ENSP ID: ENSP00000352673
MAATCEISNIFSNYFSAMYSSEDSTLASVPPAATFGADDLVLTLSNPQMSLEGTEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFIRDILIHPELNEGLMKWENRHEGVFKFLRSEAVAQLWGQKKKNSNMTYEKLSRAMRYYYKREILERVDGRRLVYKFGKNSSGWKEEEVLQSRN

SEQ ID NO: 26447 - protein, 371 aa, Homo sapiens; identical to SEQ ID NO: 26446
  Payload ID: 5210
  Gene Symbol: ELF3
  Gene Name: E74-like factor 3 (ets domain transcription factor, epithelial-specific )
  Uniprot ID: P78545
  ENSP ID: ENSP00000356252

SEQ ID NO: 26448 - protein, 371 aa, Homo sapiens; identical to SEQ ID NO: 26446
  Payload ID: 5210
  Gene Symbol: ELF3
  Gene Name: E74-like factor 3 (ets domain transcription factor, epithelial-specific )
  Uniprot ID: P78545
  ENSP ID: ENSP00000356253

SEQ ID NO: 26449 - protein, 232 aa, Homo sapiens
  Payload ID: 5210
  Gene Symbol: ELF3
  Gene Name: E74-like factor 3 (ets domain transcription factor, epithelial-specific )
  ENSP ID: ENSP00000405162
MAATCEISNIFSNYFSAMYSSEDSTLASVPPAATFGADDLVLTLSNPQMSLEEKASWLGEQPQFWSKTQVLDWISYQVEKNKYDASAIDFSRCDMDGATLCNCALEELRLVFGPLGDQLHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRD

SEQ ID NO: 26450 - protein, 663 aa, Homo sapiens
  Payload ID: 5211
  Gene Symbol: ELF4
  Gene Name: E74-like factor 4 (ets domain transcription factor)
  Uniprot ID: Q99607
  ENSP ID: ENSP00000311280
MAITLQPSDLIFEFASNGMDDDIHQLEDPSVFPAVIVEQVPYPDLLHLYSGLELDDVHNGIITDGTLCMTQDQILEGSFLLTDDNEATSHTMSTAEVLLNMESPSDILDEKQIFSTSEMLPDSDPAPAVTLPNYLFPASEPDALNRAGDTSDQEGHSLEEKASREESAKKTGKSKKRIRKTKGNRSTSPVTDPSIPIRKKSKDGKGSTIYLWEFLLALLQDRNTCPKYIKWTQREKGIFKLVDSKAVSKLWGKQKNKPDMNYETMGRALRYYYQRGILAKVEGQRLVYQFKEMPKDLVVIEDEDESSEATAAPPQASTASVASASTTRRTSSRVSSRSAPQGKGSSSWEKPKIQHVGLQPSASLELGPSLDEEIPTTSTMLVSPAEGQVKLTKAVSASSVPSNIHLGVAPVGSGSALTLQTIPLTTVLTNGPPASTTAPTQLVLQSVPAASTFKDTFTLQASFPLNASFQDSQVAAPGAPLILSGLPQLLAGANRPTNPAPPTVTGAGPAGPSSQPPGTVIAAFIRTSGTTAAPRVKEGPLRSSSYVQGMVTGAPMEGLLVPEETLRELLRDQAHLQPLPTQVVSRGSHNPSLLGNQTLSPPSRPTVGLTPVAELELSSGSGSLLMAEPSVTTSGSLLTRSPTPAPFSPFNPTSLIKMEPHDI

SEQ ID NO: 26451 - protein, 663 aa, Homo sapiens; identical to SEQ ID NO: 26450
  Payload ID: 5211
  Gene Symbol: ELF4
  Gene Name: E74-like factor 4 (ets domain transcription factor)
  Uniprot ID: Q99607
  ENSP ID: ENSP00000338608

SEQ ID NO: 26452 - protein, 76 aa, Homo sapiens
  Payload ID: 5211
  Gene Symbol: ELF4
  Gene Name: E74-like factor 4 (ets domain transcription factor)
  ENSP ID: ENSP00000407572
MDDDIHQLEDPSVFPAVIVEQVPYPDLLHLYSGLELDDVHNGIITDGTLCMTQDQILEGSFLLTDDNEATSHTMST

SEQ ID NO: 26453 - protein, 662 aa, Homo sapiens
  Payload ID: 5211
  Gene Symbol: ELF4
  Gene Name: E74-like factor 4 (ets domain transcription factor)
  ENSP ID: ENSP00000478297
MAITLQPSDLIFEFASNGMDDDIHQLEDPSVFPAVIVEQVPYPDLLHLYSGLELDDVHNGIITDGTLCMTQDQILEGSFLLTDDNEATSHTMSTAEVLLNMESPSDILDEKQIFSTSEMLPDSDPAPAVTLPNYLFPASEPDALNRAGDTSDQEGHSLEEKASREESAKKTGKSKKRIRKTKGNRSTSPVTDPSIPIRKKSKDGKGSTIYLWEFLLALLQDRNTCPKYIKWTQREKGIFKLVDSKAVSKLWGKQKNKPDMNYETMGRALRYYYQRGILAKVEGQRLVYQFKEMPKDLVVIEDEDESSEATAAPPQASTASVASASTTRRTSSRVIQICPPGQGQLFLGEAKNSACRSPAICESGIGTVARRGDPHYLHHARLSSRGPGQAHQSCECIFSAQQHPPRSGPRGSGSALTLQTIPLTTVLTNGPPASTTAPTQLVLQSVPAASTFKDTFTLQASFPLNASFQDSQVAAPGAPLILSGLPQLLAGANRPTNPAPPTVTGAGPAGPSSQPPGTVIAAFIRTSGTTAAPRVKEGPLRSSSYVQGMVTGAPMEGLLVPEETLRELLRDQAHLQPLPTQVVSRGSHNPSLLGNQTLSPPSRPTVGLTPVAELELSSGSGSLLMAEPSVTTSGSLLTRSPTPAPFSPFNPTSLIKMEPHDI

SEQ ID NO: 26454 - protein, 255 aa, Homo sapiens
  Payload ID: 5212
  Gene Symbol: ELF5
  Gene Name: E74-like factor 5 (ets domain transcription factor)
  Uniprot ID: Q9UKW6
  ENSP ID: ENSP00000257832
MLDSVTHSTFLPNASFCDPLMSWTDLFSNEEYYPAFEHQTACDSYWTSVHPEYWTKRHVWEWLQFCCDQYKLDTNCISFCNFNISGLQLCSMTQEEFVEAAGLCGEYLYFILQNIRTQGYSFFNDAEESKATIKDYADSNCLKTSGIKSQDCHSHSRTSLQSSHLWEFVRDLLLSPEENCGILEWEDREQGIFRVVKSEALAKMWGQRKKNDRMTYEKLSRALRYYYKTGILERVDRRLVYKFGKNAHGWQEDKL

SEQ ID NO: 26455 - protein, 265 aa, Homo sapiens
  Payload ID: 5212
  Gene Symbol: ELF5
  Gene Name: E74-like factor 5 (ets domain transcription factor)
  Uniprot ID: Q9UKW6
  ENSP ID: ENSP00000311010
MPSLPHSHRVMLDSVTHSTFLPNASFCDPLMSWTDLFSNEEYYPAFEHQTACDSYWTSVHPEYWTKRHVWEWLQFCCDQYKLDTNCISFCNFNISGLQLCSMTQEEFVEAAGLCGEYLYFILQNIRTQGYSFFNDAEESKATIKDYADSNCLKTSGIKSQDCHSHSRTSLQSSHLWEFVRDLLLSPEENCGILEWEDREQGIFRVVKSEALAKMWGQRKKNDRMTYEKLSRALRYYYKTGILERVDRRLVYKFGKNAHGWQEDKL

SEQ ID NO: 26456 - protein, 160 aa, Homo sapiens
  Payload ID: 5212
  Gene Symbol: ELF5
  Gene Name: E74-like factor 5 (ets domain transcription factor)
  Uniprot ID: Q9UKW6
  ENSP ID: ENSP00000407589
MLDSVTHSTFLPNASFCDPLMSWTDLFSNEEYYPAFEHQTDADSNCLKTSGIKSQDCHSHSRTSLQSSHLWEFVRDLLLSPEENCGILEWEDREQGIFRVVKSEALAKMWGQRKKNDRMTYEKLSRALRYYYKTGILERVDRRLVYKFGKNAHGWQEDKL

SEQ ID NO: 26457 - protein, 138 aa, Homo sapiens
  Payload ID: 5212
  Gene Symbol: ELF5
  Gene Name: E74-like factor 5 (ets domain transcription factor)
  Uniprot ID: Q9UKW6
  ENSP ID: ENSP00000436386
MLDSVTHSTFLPNASFCDPLMSWTDLFSNEEYYPAFEHQTACDSYWTSVHPEYWTKRHVWEWLQFCCDQYKLDTNCISFCNFNISGLQLCSMTQEEFVEAAGLCGEYLYFILQNIRTQGQCSEGQTSRGGTRIRTKQL

SEQ ID NO: 26458 - protein, 187 aa, Homo sapiens
  Payload ID: 5212
  Gene Symbol: ELF5
  Gene Name: E74-like factor 5 (ets domain transcription factor)
  ENSP ID: ENSP00000484521
MPSLPHSHRVMLDSVTHSTFLPNASFCDPLMSWTDLFSNEEYYPAFEHQTGYSFFNDAEESKATIKDYADSNCLKTSGIKSQDCHSHSRTSLQSSHLWEFVRDLLLSPEENCGILEWEDREQGIFRVVKSEALAKMWGQRKKNDRMTYEKLSRALRYYYKTGILERVDRRLVYKFGKNAHGWQEDKL

SEQ ID NO: 26459 - protein, 591 aa, Homo sapiens
  Payload ID: 5213
  Gene Symbol: EBF1
  Gene Name: early B-cell factor 1
  Uniprot ID: Q9UH73
  ENSP ID: ENSP00000322898
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGIRTEQDFYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEGTPSYLEHATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 26460 - protein, 560 aa, Homo sapiens
  Payload ID: 5213
  Gene Symbol: EBF1
  Gene Name: early B-cell factor 1
  Uniprot ID: Q9UH73
  ENSP ID: ENSP00000370029
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGIRTEQDFYVRLIDSMTKQAIVYEGQDKNPEMCRVLLTHEIMCRFFLKFFLKCNQNCLKNAGNPRDMRRFQVVVSTTVNVDGHVLAVSDNMFVHNNSKHGRRARRLDPSEATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 26461 - protein, 523 aa, Homo sapiens
  Payload ID: 5213
  Gene Symbol: EBF1
  Gene Name: early B-cell factor 1
  ENSP ID: ENSP00000428020
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGIRTEQDFYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQVVPSSPTMASSTSLPSNCSSSSGIFSFSPANMVSAVKQKSAFAPVVRPQTSPPPTCTSTNGNSLQAISGMIVPPM

SEQ ID NO: 26462 - protein, 407 aa, Homo sapiens
  Payload ID: 5213
  Gene Symbol: EBF1
  Gene Name: early B-cell factor 1
  ENSP ID: ENSP00000477809
RFFLKFFLKCNQNCLKNAGNPRDMRRFQVVVSTTVNVDGHVLAVSDNMFVHNNSKHGRRARRLDPSEGTPSYLEHATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 26463 - protein, 427 aa, Homo sapiens
  Payload ID: 5214
  Gene Symbol: EBF2
  Gene Name: early B-cell factor 2
  ENSP ID: ENSP00000386178
MCRVLLTHEVMCSRCCEKKSCGNRNETPSDPVIIDRFFLKFFLKCNQNCLKTAGNPRDMRRFQVVLSTTVNVDGHVLAVSDNMFVHNNSKHGRRARRLDPSEATPCIKAISPSEGWTTGGAMVIIIGDNFFDGLQVVFGTMLVWSELITPHAIRVQTPPRHIPGVVEVTLSYKSKQFCKGAPGRFIYTALNEPTIDYGFQRLQKVIPRHPGDPERLAKEMLLKRAADLVEALYGTPHNNQDIILKRAADIAEALYSVPRNPSQLPALSSSPAHSGMMGINSYGSQLGVSISESTQGNNQGYIRNTSSISPRGYSSSSTPQQSNYSTSSNSMNGYSNVPMANLGVPGSPGFLNGSPTGSPYGIMSSSPTVGSSSTSSILPFSSSVFPAVKQKSAFAPVIRPQGSPSPACSSGNGNGFRAMTGLVVPPM

SEQ ID NO: 26464 - protein, 575 aa, Homo sapiens
  Payload ID: 5214
  Gene Symbol: EBF2
  Gene Name: early B-cell factor 2
  Uniprot ID: Q9HAK2
  ENSP ID: ENSP00000430241
MFGIQDTLGRGPTLKEKSLGAEMDSVRSWVRNVGVVDANVAAQSGVALSRAHFEKQPPSNLRKSNFFHFVLALYDRQGQPVEIERTAFVDFVENDKEQGNEKTNNGTHYKLQLLYSNGVRTEQDLYVRLIDSVTKQPIAYEGQNKNPEMCRVLLTHEVMCSRCCEKKSCGNRNETPSDPVIIDRFFLKFFLKCNQNCLKTAGNPRDMRRFQVVLSTTVNVDGHVLAVSDNMFVHNNSKHGRRARRLDPSEATPCIKAISPSEGWTTGGAMVIIIGDNFFDGLQVVFGTMLVWSELITPHAIRVQTPPRHIPGVVEVTLSYKSKQFCKGAPGRFIYTALNEPTIDYGFQRLQKVIPRHPGDPERLAKEMLLKRAADLVEALYGTPHNNQDIILKRAADIAEALYSVPRNPSQLPALSSSPAHSGMMGINSYGSQLGVSISESTQGNNQGYIRNTSSISPRGYSSSSTPQQSNYSTSSNSMNGYSNVPMANLGVPGSPGFLNGSPTGSPYGIMSSSPTVGSSSTSSILPFSSSVFPAVKQKSAFAPVIRPQGSPSPACSSGNGNGFRAMTGLVVPPM

SEQ ID NO: 26465 - protein, 264 aa, Homo sapiens
  Payload ID: 5214
  Gene Symbol: EBF2
  Gene Name: early B-cell factor 2
  Uniprot ID: Q9HAK2
  ENSP ID: ENSP00000437909
MVIIIGDNFFDGLQVVFGTMLVWSELITPHAIRVQTPPRHIPGVVEVTLSYKSKQFCKGAPGRFIYTALNEPTIDYGFQRLQKVIPRHPGDPERLAKEMLLKRAADLVEALYGTPHNNQDIILKRAADIAEALYSVPRNPSQLPALSSSPAHSGMMGINSYGSQLGVSISESTQGNNQGYIRNTSSISPRGYSSSSTPQQSNYSTSSNSMNGYSNVPMANLGVPGSPGFLNGSPTGSPYGTGLWLTWLLKAFWGKKRIETIPFL

SEQ ID NO: 26466 - protein, 596 aa, Homo sapiens
  Payload ID: 5215
  Gene Symbol: EBF3
  Gene Name: early B-cell factor 3
  Uniprot ID: Q9H4W6
  ENSP ID: ENSP00000347463
MFGIQENIPRGGTTMKEEPLGSGMNPVRSWMHTAGVVDANTAAQSGVGLARAHFEKQPPSNLRKSNFFHFVLALYDRQGQPVEIERTAFVDFVEKEKEPNNEKTNNGIHYKLQLLYSNGVRTEQDLYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEGTAPSYLENATPCIKAISPSEGWTTGGATVIIIGDNFFDGLQVVFGTMLVWSELITPHAIRVQTPPRHIPGVVEVTLSYKSKQFCKGAPGRFVYTALNEPTIDYGFQRLQKVIPRHPGDPERLPKEVLLKRAADLVEALYGMPHNNQEIILKRAADIAEALYSVPRNHNQIPTLGNNPAHTGMMGVNSFSSQLAVNVSETSQANDQVGYSRNTSSVSPRGYVPSSTPQQSNYNTVSTSMNGYGSGAMASLGVPGSPGFLNGSSANSPYGIVPSSPTMAASSVTLPSNCSSTHGIFSFSPANVISAVKQKSAFAPVVRPQASPPPSCTSANGNGLQAMSGLVVPPM

SEQ ID NO: 26467 - protein, 551 aa, Homo sapiens
  Payload ID: 5215
  Gene Symbol: EBF3
  Gene Name: early B-cell factor 3
  Uniprot ID: Q9H4W6
  ENSP ID: ENSP00000357637
MFGIQENIPRGGTTMKEEPLGSGMNPVRSWMHTAGVVDANTAAQSGVGLARAHFEKQPPSNLRKSNFFHFVLALYDRQGQPVEIERTAFVDFVEKEKEPNNEKTNNGIHYKLQLLYSNGVRTEQDLYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEATPCIKAISPSEGWTTGGATVIIIGDNFFDGLQVVFGTMLVWSELITPHAIRVQTPPRHIPGVVEVTLSYKSKQFCKGAPGRFVYTALNEPTIDYGFQRLQKVIPRHPGDPERLPKEVLLKRAADLVEALYGMPHNNQEIILKRAADIAEALYSVPRNHNQIPTLGNNPAHTGMMGVNSFSSQLAVNVSETSQANDQVGYSRNTSSVSPRGYVPSSTPQQSNYNTVSTSMNGYGSGAMASLGVPGSPGFLNGSSANSPYGMKQKSAFAPVVRPQASPPPSCTSANGNGLQAMSGLVVPPM

SEQ ID NO: 26468 - protein, 191 aa, Homo sapiens
  Payload ID: 5215
  Gene Symbol: EBF3
  Gene Name: early B-cell factor 3
  ENSP ID: ENSP00000387543
  MOD_RES (1)..(1): Any amino acid
XFSSQLAVNVSETSQANDQVGYSRNTSSVSPRGYVPSSTPQQSNYNTVSTSMNGYGSGAMASLGVPGSPGFLNGSSANSPYGIVPSSPTMAASSVTLPSNCSSTHGIFSFSPANVISAVKQKSAFAPVVRPQASPPPSCTSANGNGLQGSLLGAEDVAAEKTNWPFCEVGGIFHFDELMLKKGTGKLCLGW

SEQ ID NO: 26469 - protein, 621 aa, Homo sapiens
  Payload ID: 5216
  Gene Symbol: EBF4
  Gene Name: early B-cell factor 4
  ENSP ID: ENSP00000345030
RPRRGGAGTGPRGESAGLLLLLLQDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 26470 - protein, 598 aa, Homo sapiens
  Payload ID: 5216
  Gene Symbol: EBF4
  Gene Name: early B-cell factor 4
  ENSP ID: ENSP00000370022
MDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 26471 - protein, 540 aa, Homo sapiens
  Payload ID: 5216
  Gene Symbol: EBF4
  Gene Name: early B-cell factor 4
  ENSP ID: ENSP00000405003
MDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAKERLRPRAAPPKLPTPGLPQSPRRGASRPVF

SEQ ID NO: 26472 - protein, 602 aa, Homo sapiens
  Payload ID: 5216
  Gene Symbol: EBF4
  Gene Name: early B-cell factor 4
  Uniprot ID: Q9BQW3
  ENSP ID: ENSP00000477023
MFPAQDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 26473 - protein, 177 aa, Homo sapiens
  Payload ID: 5216
  Gene Symbol: EBF4
  Gene Name: early B-cell factor 4
  ENSP ID: ENSP00000477107
LIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAAPTSFETCTLMLAASCLPVGALGMEEAEEGVPGLLYLGSSPSGCLMDSGPTHSQ

SEQ ID NO: 26474 - protein, 1411 aa, Homo sapiens
  Payload ID: 5217
  Gene Symbol: EEA1
  Gene Name: early endosome antigen 1
  Uniprot ID: Q15075
  ENSP ID: ENSP00000317955
MLRRILQRTPGRVGSQGSDLDSSATPINTVDVNNESSSEGFICPQCMKSLGSADELFKHYEAVHDAGNDSGHGGESNLALKRDDVTLLRQEVQDLQASLKEEKWYSEELKKELEKYQGLQQQEAKPDGLVTDSSAELQSLEQQLEEAQTENFNIKQMKDLFEQKAAQLATEIADIKSKYDEERSLREAAEQKVTRLTEELNKEATVIQDLKTELLQRPGIEDVAVLKKELVQVQTLMDNMTLERERESEKLKDECKKLQSQYASSEATISQLRSELAKGPQEVAVYVQELQKLKSSVNELTQKNQTLTENLLKKEQDYTKLEEKHNEESVSKKNIQATLHQKDLDCQQLQSRLSASETSLHRIHVELSEKGEATQKLKEELSEVETKYQHLKAEFKQLQQQREEKEQHGLQLQSEINQLHSKLLETERQLGEAHGRLKEQRQLSSEKLMDKEQQVADLQLKLSRLEEQLKEKVTNSTELQHQLDKTKQQHQEQQALQQSTTAKLREAQNDLEQVLRQIGDKDQKIQNLEALLQKSKENISLLEKEREDLYAKIQAGEGETAVLNQLQEKNHTLQEQVTQLTEKLKNQSESHKQAQENLHDQVQEQKAHLRAAQDRVLSLETSVNELNSQLNESKEKVSQLDIQIKAKTELLLSAEAAKTAQRADLQNHLDTAQNALQDKQQELNKITTQLDQVTAKLQDKQEHCSQLESHLKEYKEKYLSLEQKTEELEGQIKKLEADSLEVKASKEQALQDLQQQRQLNTDLELRATELSKQLEMEKEIVSSTRLDLQKKSEALESIKQKLTKQEEEKKILKQDFETLSQETKIQHEELNNRIQTTVTELQKVKMEKEALMTELSTVKDKLSKVSDSLKNSKSEFEKENQKGKAAILDLEKTCKELKHQLQVQMENTLKEQKELKKSLEKEKEASHQLKLELNSMQEQLIQAQNTLKQNEKEEQQLQGNINELKQSSEQKKKQIEALQGELKIAVLQKTELENKLQQQLTQAAQELAAEKEKISVLQNNYEKSQETFKQLQSDFYGRESELLATRQDLKSVEEKLSLAQEDLISNRNQIGNQNKLIQELKTAKATLEQDSAKKEQQLQERCKALQDIQKEKSLKEKELVNEKSKLAEIEEIKCRQEKEITKLNEELKSHKLESIKEITNLKDAKQLLIQQKLELQGKADSLKAAVEQEKRNQQILKDQVKKEEEELKKEFIEKEAKLHSEIKEKEVGMKKHEENEAKLTMQITALNENLGTVKKEWQSSQRRVSELEKQTDDLRGEIAVLEATVQNNQDERRALLERCLKGEGEIEKLQTKVLELQRKLDNTTAAVQELGRENQSLQIKHTQALNRKWAEDNEVQNCMACGKGFSVTVRRHHCRQCGNIFCAECSAKNALTPSSKKPVRVCDACFNDLQG

SEQ ID NO: 26475 - protein, 40 aa, Homo sapiens
  Payload ID: 5217
  Gene Symbol: EEA1
  Gene Name: early endosome antigen 1
  ENSP ID: ENSP00000394312
MLRRILQRTPGRVGSQGSDLDSSATPINTVDVNNESSSER

SEQ ID NO: 26476 - protein, 42 aa, Homo sapiens
  Payload ID: 5217
  Gene Symbol: EEA1
  Gene Name: early endosome antigen 1
  ENSP ID: ENSP00000446785
MKARRRSPSLTYRLKPKPNYYYQQKQQKLLKELIFRIIWTQL

SEQ ID NO: 26477 - protein, 43 aa, Homo sapiens
  Payload ID: 5217
  Gene Symbol: EEA1
  Gene Name: early endosome antigen 1
  ENSP ID: ENSP00000449682
MLRRILQRTPGRVGSQGSDLDSSATPINTVDVNNESSSEVEHP

SEQ ID NO: 26478 - protein, 543 aa, Homo sapiens
  Payload ID: 5218
  Gene Symbol: EGR1
  Gene Name: early growth response 1
  Uniprot ID: P18146
  ENSP ID: ENSP00000239938
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 26479 - protein, 476 aa, Homo sapiens
  Payload ID: 5219
  Gene Symbol: EGR2
  Gene Name: early growth response 2
  Uniprot ID: P11161
  ENSP ID: ENSP00000242480
MMTAKAVDKIPVTLSGFVHQLSDNIYPVEDLAATSVTIFPNAELGGPFDQMNGVAGDGMINIDMTGEKRSLDLPYPSSFAPVSAPRNQTFTYMGKFSIDPQYPGASCYPEGIINIVSAGILQGVTSPASTTASSSVTSASPNPLATGPLGVCTMSQTQPDLDHLYSPPPPPPPYSGCAGDLYQDPSAFLSAATTSTSSSLAYPPPPSYPSPKPATDPGLFPMIPDYPGFFPSQCQRDLHGTAGPDRKPFPCPLDTLRVPPPLTPLSTIRNFTLGGPSAGVTGPGASGGSEGPRLPGSSSAAAAAAAAAAYNPHHLPLRPILRPRKYPNRPSKTPVHERPYPCPAEGCDRRFSRSDELTRHIRIHTGHKPFQCRICMRNFSRSDHLTTHIRTHTGEKPFACDYCGRKFARSDERKRHTKIHLRQKERKSSAPSASVPAPSTASCSGGVQPGGTLCSSNSSSLGGGPLAPCSSRTRTP

SEQ ID NO: 26480 - protein, 426 aa, Homo sapiens
  Payload ID: 5219
  Gene Symbol: EGR2
  Gene Name: early growth response 2
  Uniprot ID: P11161
  ENSP ID: ENSP00000387634
MNGVAGDGMINIDMTGEKRSLDLPYPSSFAPVSAPRNQTFTYMGKFSIDPQYPGASCYPEGIINIVSAGILQGVTSPASTTASSSVTSASPNPLATGPLGVCTMSQTQPDLDHLYSPPPPPPPYSGCAGDLYQDPSAFLSAATTSTSSSLAYPPPPSYPSPKPATDPGLFPMIPDYPGFFPSQCQRDLHGTAGPDRKPFPCPLDTLRVPPPLTPLSTIRNFTLGGPSAGVTGPGASGGSEGPRLPGSSSAAAAAAAAAAYNPHHLPLRPILRPRKYPNRPSKTPVHERPYPCPAEGCDRRFSRSDELTRHIRIHTGHKPFQCRICMRNFSRSDHLTTHIRTHTGEKPFACDYCGRKFARSDERKRHTKIHLRQKERKSSAPSASVPAPSTASCSGGVQPGGTLCSSNSSSLGGGPLAPCSSRTRTP

SEQ ID NO: 26481 - protein, 476 aa, Homo sapiens; identical to SEQ ID NO: 26479
  Payload ID: 5219
  Gene Symbol: EGR2
  Gene Name: early growth response 2
  Uniprot ID: P11161
  ENSP ID: ENSP00000402040

SEQ ID NO: 26482 - protein, 387 aa, Homo sapiens
  Payload ID: 5220
  Gene Symbol: EGR3
  Gene Name: early growth response 3
  Uniprot ID: Q06889
  ENSP ID: ENSP00000318057
MTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRSDELTRHLRIHTGHKPFQCRICMRSFSRSDHLTTHIRTHTGEKPFACEFCGRKFARSDERKRHAKIHLKQKEKKAEKGGAPSASSAPPVSLAPVVTTCA

SEQ ID NO: 26483 - protein, 71 aa, Homo sapiens
  Payload ID: 5220
  Gene Symbol: EGR3
  Gene Name: early growth response 3
  ENSP ID: ENSP00000429370
MTGKLAEKLPVTMSSLLNQLPDNLYPEEIPSALNLFSGSSDSVVHYNQMATASHPGWSHVRRGVPAVGERM

SEQ ID NO: 26484 - protein, 349 aa, Homo sapiens
  Payload ID: 5220
  Gene Symbol: EGR3
  Gene Name: early growth response 3
  Uniprot ID: Q06889
  ENSP ID: ENSP00000430310
MEPCAAWSPRGGRENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRSDELTRHLRIHTGHKPFQCRICMRSFSRSDHLTTHIRTHTGEKPFACEFCGRKFARSDERKRHAKIHLKQKEKKAEKGGAPSASSAPPVSLAPVVTTCA

SEQ ID NO: 26485 - protein, 486 aa, Homo sapiens
  Payload ID: 5221
  Gene Symbol: EGR4
  Gene Name: early growth response 4
  ENSP ID: ENSP00000419687
MLHLSEFSEPDALLVKSTEGCCAEPSAELPRLPARDAPAATGYPGAGDFLSWALNSCGASGDLADSCFLEGPAPTPPPGLSYSGSFFIQAVPEHPHDPEALFNLMSGILGLAPFPGPEAAASRSPLDAPFPAGSDALLPGPPDLYSPDLGAAPFPEAFWEASPCAGAPSQCLYEPQLSPPDVKPGLRAPPASPALDAVSAFKGPYAPWELLSVGAPGNCGSQGDYQAAPEARFPVIGTKIEDLLSISCPAELPAVPANRLYPSGAYDAFPLAPGDLGEGAEGLPGLLTPPSGEGGSSGDGGEFLASTQPQLSPLGLRSAAAADFPKPLVADIPGSSGVAAPPVPPPPPTPFPQAKARRKGRRGGKCSTRCFCPRPHAKAFACPVESCVRSFARSDELNRHLRIHTGHKPFQCRICLRNFSRSDHLTTHVRTHTGEKPFACDVCGRRFARSDEKKRHSKVHLKQKARAEERLKGLGFYSLGLSFASL

SEQ ID NO: 26486 - protein, 589 aa, Homo sapiens
  Payload ID: 5221
  Gene Symbol: EGR4
  Gene Name: early growth response 4
  Uniprot ID: Q05215
  ENSP ID: ENSP00000445626
MAVARGVGSPEPAPPQLYKWGGCGLGEPGSALERRGAAARGRCGRARAPRLPDSFPRGECPKPGARAPRSVRCGEPLPPASPPPARPQAQRARPRAPHSRRRAMLHLSEFSEPDALLVKSTEGCCAEPSAELPRLPARDAPAATGYPGAGDFLSWALNSCGASGDLADSCFLEGPAPTPPPGLSYSGSFFIQAVPEHPHDPEALFNLMSGILGLAPFPGPEAAASRSPLDAPFPAGSDALLPGPPDLYSPDLGAAPFPEAFWEASPCAGAPSQCLYEPQLSPPDVKPGLRAPPASPALDAVSAFKGPYAPWELLSVGAPGNCGSQGDYQAAPEARFPVIGTKIEDLLSISCPAELPAVPANRLYPSGAYDAFPLAPGDLGEGAEGLPGLLTPPSGEGGSSGDGGEFLASTQPQLSPLGLRSAAAADFPKPLVADIPGSSGVAAPPVPPPPPTPFPQAKARRKGRRGGKCSTRCFCPRPHAKAFACPVESCVRSFARSDELNRHLRIHTGHKPFQCRICLRNFSRSDHLTTHVRTHTGEKPFACDVCGRRFARSDEKKRHSKVHLKQKARAEERLKGLGFYSLGLSFASL

SEQ ID NO: 26487 - protein, 306 aa, Homo sapiens
  Payload ID: 5222
  Gene Symbol: EBNA1BP2
  Gene Name: EBNA1 binding protein 2
  Uniprot ID: Q99848
  ENSP ID: ENSP00000236051
MDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKNRTH

SEQ ID NO: 26488 - protein, 361 aa, Homo sapiens
  Payload ID: 5222
  Gene Symbol: EBNA1BP2
  Gene Name: EBNA1 binding protein 2
  ENSP ID: ENSP00000407323
MYPEALPVGILSNPDTFKRRSGSYSNDKPEVWFAAGSGSPNQKLSSSCVGRACGEMDTPPLSDSESESDESLVTDRELQDAFSRGLLKPGLNVVLEGPKKAVNDVNGLKQCLAEFKRDLEWVERLDVTLGPVPEIGGSEAPAPQNKDQKAVDPEDDFQREMSFYRQAQAAVLAVLPRLHQLKVPTKRPTDYFAEMAKSDLQMQKIRQKLQTKQAAMERSEKAKQLRALRKYGKKVQTEVLQKRQQEKAHMMNAIKKYQKGFSDKLDFLEGDQKPLAQRKKAGAKGQQMRKGPSAKRRYKNQKFGFGGKKKGSKWNTRESYDDVSSFRAKTAHGRGLKRPGKKGSNKRPGKRTREKMKNRTH

SEQ ID NO: 26489 - protein, 644 aa, Homo sapiens
  Payload ID: 5223
  Gene Symbol: ECD
  Gene Name: ecdysoneless homolog (Drosophila)
  Uniprot ID: O95905
  ENSP ID: ENSP00000362070
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 26490 - protein, 212 aa, Homo sapiens
  Payload ID: 5223
  Gene Symbol: ECD
  Gene Name: ecdysoneless homolog (Drosophila)
  ENSP ID: ENSP00000391367
MFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYR

SEQ ID NO: 26491 - protein, 601 aa, Homo sapiens
  Payload ID: 5223
  Gene Symbol: ECD
  Gene Name: ecdysoneless homolog (Drosophila)
  Uniprot ID: O95905
  ENSP ID: ENSP00000395786
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 26492 - protein, 677 aa, Homo sapiens
  Payload ID: 5223
  Gene Symbol: ECD
  Gene Name: ecdysoneless homolog (Drosophila)
  Uniprot ID: O95905
  ENSP ID: ENSP00000401566
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPERLEVQWRDPGLLQAPPPGFTPFICLSLLSTWDNSSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 26493 - protein, 217 aa, Homo sapiens
  Payload ID: 5223
  Gene Symbol: ECD
  Gene Name: ecdysoneless homolog (Drosophila)
  ENSP ID: ENSP00000416288
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVASTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDL

SEQ ID NO: 26494 - protein, 163 aa, Homo sapiens
  Payload ID: 5223
  Gene Symbol: ECD
  Gene Name: ecdysoneless homolog (Drosophila)
  ENSP ID: ENSP00000433778
MFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGSHSLNVYMHNWCNKGLCQTGGVDTGCLLHLIPSTEPMNWA

SEQ ID NO: 26495 - protein, 87 aa, Homo sapiens
  Payload ID: 5223
  Gene Symbol: ECD
  Gene Name: ecdysoneless homolog (Drosophila)
  ENSP ID: ENSP00000475102
  MOD_RES (1)..(1): Any amino acid
XSVMAPVDVDLNLVSNILESYSSQAGLAGPASNLLQSMGVQLPDNTDHRPTNGVSLCCPGWSAVALSWLNASSTSQVHAILLPQPPE

SEQ ID NO: 26496 - protein, 815 aa, Homo sapiens
  Payload ID: 5224
  Gene Symbol: EML1
  Gene Name: echinoderm microtubule associated protein like 1
  Uniprot ID: O00423
  ENSP ID: ENSP00000262233
MEDGFSSYSSLYDTSSLLQFCNDDSASAASSMEVTDRIASLEQRVQMQEDDIQLLKSALADVVRRLNITEEQQAVLNRKGPTKARPLMQTLPLRTTVNNGTVLPKKPTGSLPSPSGVRKETAVPATKSNIKRTSSSERVSPGGRRESNGDSRGNRNRTGSTSSSSSGKKNSESKPKEPVFSAEEGYVKMFLRGRPVTMYMPKDQVDSYSLEAKVELPTKRLKLEWVYGYRGRDCRNNLYLLPTGETVYFIASVVVLYNVEEQLQRHYAGHNDDVKCLAVHPDRITIATGQVAGTSKDGKQLPPHVRIWDSVTLNTLHVIGIGFFDRAVTCIAFSKSNGGTNLCAVDDSNDHVLSVWDWQKEEKLADVKCSNEAVFAADFHPTDTNIIVTCGKSHLYFWTLEGSSLNKKQGLFEKQEKPKFVLCVTFSENGDTITGDSSGNILVWGKGTNRISYAVQGAHEGGIFALCMLRDGTLVSGGGKDRKLISWSGNYQKLRKTEIPEQFGPIRTVAEGKGDVILIGTTRNFVLQGTLSGDFTPITQGHTDELWGLAIHASKSQFLTCGHDKHATLWDAVGHRPVWDKIIEDPAQSSGFHPSGSVVAVGTLTGRWFVFDTETKDLVTVHTDGNEQLSVMRYSPDGNFLAIGSHDNCIYIYGVSDNGRKYTRVGKCSGHSSFITHLDWSVNSQFLVSNSGDYEILYWVPSACKQVVSVETTRDIEWATYTCTLGFHVFGVWPEGSDGTDINAVCRAHEKKLLSTGDDFGKVHLFSYPCSQFRAPSHIYGGHSSHVTNVDFLCEDSHLISTGGKDTSIMQWRVI

SEQ ID NO: 26497 - protein, 803 aa, Homo sapiens
  Payload ID: 5224
  Gene Symbol: EML1
  Gene Name: echinoderm microtubule associated protein like 1
  ENSP ID: ENSP00000327384
MEVTDRIASLEQRVQMQEDDIQLLKSALADVVRRLNITEEQQAVLNRKGPTKARPLMQTLPLRTTVNNGTVLPKKPTGSLPSPSGVRKETAVPATKRLNRSVSLLNACKLNRSTPSNIKRTSSSERVSPGGRRESNGDSRGNRNRTGSTSSSSSGKKNSESKPKEPVFSAEEGYVKMFLRGRPVTMYMPKDQVDSYSLEAKVELPTKRLKLEWVYGYRGRDCRNNLYLLPTGETVYFIASVVVLYNVEEQLQRHYAGHNDDVKCLAVHPDRITIATGQVAGTSKDGKQLPPHVRIWDSVTLNTLHVIGIGFFDRAVTCIAFSKSNGGTNLCAVDDSNDHVLSVWDWQKEEKLADVKCSNEAVFAADFHPTDTNIIVTCGKSHLYFWTLEGSSLNKKQGLFEKQEKPKFVLCVTFSENGDTITGDSSGNILVWGKGTNRISYAVQGAHEGGIFALCMLRDGTLVSGGGKDRKLISWSGNYQKLRKTEIPEQFGPIRTVAEGKGDVILIGTTRNFVLQGTLSGDFTPITQGHTDELWGLAIHASKSQFLTCGHDKHATLWDAVGHRPVWDKIIEDPAQSSGFHPSGSVVAVGTLTGRWFVFDTETKDLVTVHTDGNEQLSVMRYSPDGNFLAIGSHDNCIYIYGVSDNGRKYTRVGKCSGHSSFITHLDWSVNSQFLVSNSGDYEILYWVPSACKQVVSVETTRDIEWATYTCTLGFHVFGVWPEGSDGTDINAVCRAHEKKLLSTGDDFGKVHLFSYPCSQFRAPSHIYGGHSSHVTNVDFLCEDSHLISTGGKDTSIMQWRVI

SEQ ID NO: 26498 - protein, 834 aa, Homo sapiens
  Payload ID: 5224
  Gene Symbol: EML1
  Gene Name: echinoderm microtubule associated protein like 1
  Uniprot ID: O00423
  ENSP ID: ENSP00000334314
MEDGFSSYSSLYDTSSLLQFCNDDSASAASSMEVTDRIASLEQRVQMQEDDIQLLKSALADVVRRLNITEEQQAVLNRKGPTKARPLMQTLPLRTTVNNGTVLPKKPTGSLPSPSGVRKETAVPATKRLNRSVSLLNACKLNRSTPSNIKRTSSSERVSPGGRRESNGDSRGNRNRTGSTSSSSSGKKNSESKPKEPVFSAEEGYVKMFLRGRPVTMYMPKDQVDSYSLEAKVELPTKRLKLEWVYGYRGRDCRNNLYLLPTGETVYFIASVVVLYNVEEQLQRHYAGHNDDVKCLAVHPDRITIATGQVAGTSKDGKQLPPHVRIWDSVTLNTLHVIGIGFFDRAVTCIAFSKSNGGTNLCAVDDSNDHVLSVWDWQKEEKLADVKCSNEAVFAADFHPTDTNIIVTCGKSHLYFWTLEGSSLNKKQGLFEKQEKPKFVLCVTFSENGDTITGDSSGNILVWGKGTNRISYAVQGAHEGGIFALCMLRDGTLVSGGGKDRKLISWSGNYQKLRKTEIPEQFGPIRTVAEGKGDVILIGTTRNFVLQGTLSGDFTPITQGHTDELWGLAIHASKSQFLTCGHDKHATLWDAVGHRPVWDKIIEDPAQSSGFHPSGSVVAVGTLTGRWFVFDTETKDLVTVHTDGNEQLSVMRYSPDGNFLAIGSHDNCIYIYGVSDNGRKYTRVGKCSGHSSFITHLDWSVNSQFLVSNSGDYEILYWVPSACKQVVSVETTRDIEWATYTCTLGFHVFGVWPEGSDGTDINAVCRAHEKKLLSTGDDFGKVHLFSYPCSQFRAPSHIYGGHSSHVTNVDFLCEDSHLISTGGKDTSIMQWRVI

SEQ ID NO: 26499 - protein, 85 aa, Homo sapiens
  Payload ID: 5224
  Gene Symbol: EML1
  Gene Name: echinoderm microtubule associated protein like 1
  ENSP ID: ENSP00000451269
MEDGFSSYSSLYDTSSLLQFCNDDSASAASSMEVTDRIASLEQRVQMQEDDIQLLKSALADVVRRLNITEEQQAVLNRKGPTKDH

SEQ ID NO: 26500 - protein, 76 aa, Homo sapiens
  Payload ID: 5224
  Gene Symbol: EML1
  Gene Name: echinoderm microtubule associated protein like 1
  ENSP ID: ENSP00000451288
  MOD_RES (1)..(1): Any amino acid
XELWGLAIHASKSQFLTCGHDKHATLWDAVGHRPVWDKIIEGLWLQSEHSLGGGLCLTQKQKTWSPFTQMETNSSL

SEQ ID NO: 26501 - protein, 379 aa, Homo sapiens
  Payload ID: 5224
  Gene Symbol: EML1
  Gene Name: echinoderm microtubule associated protein like 1
  ENSP ID: ENSP00000451346
MSDGEGPSADDSASAASSMEVTDRIASLEQRVQMQEDDIQLLKSALADVVRRLNITEEQQAVLNRKGPTKARPLMQTLPLRTTVNNGTVLPKKPTGSLPSPSGVRKETAVPATKSNIKRTSSSERVSPGGRRESNGDSRGNRNRTGSTSSSSSGKKNSESKPKEPVFSAEEGYVKMFLRGRPVTMYMPKDQVDSYSLEAKVELPTKRLKLEWVYGYRGRDCRNNLYLLPTGETVYFIASVVVLYNVEEQLQRHYAGHNDDVKCLAVHPDRITIATGQVAGTSKDGKQLPPHVRIWDSVTLNTLHVIGIGFFDRAVTCIAFSKSNGGTNLCAVDDSNDHVLSVWDWQKEEKLADVKCSNEAVFAADFHPTDTNIIVTCGK

SEQ ID NO: 26502 - protein, 107 aa, Homo sapiens
  Payload ID: 5224
  Gene Symbol: EML1
  Gene Name: echinoderm microtubule associated protein like 1
  ENSP ID: ENSP00000451669
MEVTDRIASLEQRVQMQEDDIQLLKSALADVVRRLNITEEQQAVLNRKGPTKARPLMQTLPLRTTVNNGTVLPKKPTGSLPSPSGVRKETAVPATKSNIKRTSSSER

SEQ ID NO: 26503 - protein, 121 aa, Homo sapiens
  Payload ID: 5224
  Gene Symbol: EML1
  Gene Name: echinoderm microtubule associated protein like 1
  ENSP ID: ENSP00000451706
VEEQLQRHYAGHNDDVKCLAVHPDRITIATGQVAGTSKDGKQLPPHVRIWDSVTLNTLHVIGIGFFDRAVTCIAFSKSNGGTNLCAVDDSNDHVLSVWDWQKEEKLADVKRCEASESLFFL

SEQ ID NO: 26504 - protein, 128 aa, Homo sapiens
  Payload ID: 5224
  Gene Symbol: EML1
  Gene Name: echinoderm microtubule associated protein like 1
  ENSP ID: ENSP00000451805
MMYNEIGEAKKITERFIDPDKELEIMILNDSASAASSMEVTDRIASLEQRVQMQEDDIQLLKSALADVVRRLNITEEQQAVLNRKGPTKARPLMQTLPLRTTVNNGTVLPKKPTGSLPSPSGVRKETA

SEQ ID NO: 26505 - protein, 85 aa, Homo sapiens
  Payload ID: 5224
  Gene Symbol: EML1
  Gene Name: echinoderm microtubule associated protein like 1
  ENSP ID: ENSP00000451991
MEVTDRIASLEQRVQMQEDDIQLLKSALADVVRRLNITEEQQAVLNRKGPTKARPLMQTLPLRTTVNNGTVLPKKPTGSLPSPSG

SEQ ID NO: 26506 - protein, 66 aa, Homo sapiens
  Payload ID: 5224
  Gene Symbol: EML1
  Gene Name: echinoderm microtubule associated protein like 1
  ENSP ID: ENSP00000452063
GVRKETAVPATKSNIKRTSSSERVSPGGRRESNGDSRGNRNRTGSTSSSSSGKKNSERLRRLSWWR

SEQ ID NO: 26507 - protein, 285 aa, Homo sapiens
  Payload ID: 5224
  Gene Symbol: EML1
  Gene Name: echinoderm microtubule associated protein like 1
  ENSP ID: ENSP00000452089
MEVTDRIASLEQRVQMQEDDIQLLKSALADVVRRLNITEEQQAVLNRKGPTKARPLMQTLPLRTTVNNGTVLPKKPTGSLPSPSGVRKETAVPATKSNIKRTSSSERVSPGGRRESNGDSRGNRNRTGSTSSSSSGKKNSESKPKEPVFSAEEGYVKMFLRGRPVTMYMPKDQVDSYSLEAKVELPTKRLKLEWVYGYRGRDCRNNLYLLPTGETVYFIASVVVLYNVEEQLQRHYAGHNDDVKCLAVHPDRITIATGQVAGTSKDGKQLPPHVRIWDSVTLNTL

SEQ ID NO: 26508 - protein, 156 aa, Homo sapiens
  Payload ID: 5224
  Gene Symbol: EML1
  Gene Name: echinoderm microtubule associated protein like 1
  ENSP ID: ENSP00000452160
MSDGEGPSADDSASAASSMEVTDRIASLEQRVQMQEDDIQLLKSALADVVRRLNITEEQQAVLNRKGPTKARPLMQTLPLRTTVNNGTVLPKKPTGSLPSPSGVRKETAVPATKRLNRSVSLLNACKLNRSTPSNIKRTSSSERVSPGGRRESNGD

SEQ ID NO: 26509 - protein, 92 aa, Homo sapiens
  Payload ID: 5224
  Gene Symbol: EML1
  Gene Name: echinoderm microtubule associated protein like 1
  ENSP ID: ENSP00000452292
MFFDDSASAASSMEVTDRIASLEQRVQMQEDDIQLLKSALADVVRRLNITEEQQAVLNRKGPTKARPLMQTLPLRTTVNNGTVLPKKPTGSL

SEQ ID NO: 26510 - protein, 182 aa, Homo sapiens
  Payload ID: 5224
  Gene Symbol: EML1
  Gene Name: echinoderm microtubule associated protein like 1
  ENSP ID: ENSP00000452474
  MOD_RES (1)..(1): Any amino acid
XLAVHPDRITIATGQVAGTSKDGKQLPPHVRIWDSVTLNTLHVIGIGFFDRAVTCIAFSKSCSNEAVFAADFHPTDTNIIVTCGKSHLYFWTLEGSSLNKKQGLFEKQEKPKFVLCVTFSENGDTITGDSSGNILVWGKGTNRISYAVQGAHEGGIFALCMLRDGTLVSGGGKDRKLISWSG

SEQ ID NO: 26511 - protein, 649 aa, Homo sapiens
  Payload ID: 5225
  Gene Symbol: EML2
  Gene Name: echinoderm microtubule associated protein like 2
  Uniprot ID: O95834
  ENSP ID: ENSP00000245925
MSSFGAGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 26512 - protein, 603 aa, Homo sapiens
  Payload ID: 5225
  Gene Symbol: EML2
  Gene Name: echinoderm microtubule associated protein like 2
  ENSP ID: ENSP00000382503
MGVIPEGPLWVSGSDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEVESRSVTQAGGQWHDLGSLQPPPPGFK

SEQ ID NO: 26513 - protein, 796 aa, Homo sapiens
  Payload ID: 5225
  Gene Symbol: EML2
  Gene Name: echinoderm microtubule associated protein like 2
  Uniprot ID: O95834
  ENSP ID: ENSP00000442365
MSLDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 26514 - protein, 181 aa, Homo sapiens
  Payload ID: 5225
  Gene Symbol: EML2
  Gene Name: echinoderm microtubule associated protein like 2
  ENSP ID: ENSP00000464764
FLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQDPARSAGFHPSGSVLAVGTVTGRWLLLDTETHDLVAIHTDGNEQISVVSFSPDGAYLAVGSHDNLV

SEQ ID NO: 26515 - protein, 773 aa, Homo sapiens
  Payload ID: 5225
  Gene Symbol: EML2
  Gene Name: echinoderm microtubule associated protein like 2
  ENSP ID: ENSP00000464789
MSSFGAGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRVLGKWPSAAEAALSSGIRVLFRPLVASLGPAWKNVPRKFCWKSAGDSPRDPPPRPQGHSQPSFPSSGPWETAVCKFYRQGRWREVRVFASWAPPCIPHSQWLWFPSSEPQFLWELELSLETGNRLPPCPFCPRLAMASCPLRMVPWGRPILCGFLHSAHPSINCP

SEQ ID NO: 26516 - protein, 111 aa, Homo sapiens
  Payload ID: 5225
  Gene Symbol: EML2
  Gene Name: echinoderm microtubule associated protein like 2
  ENSP ID: ENSP00000464804
MFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGK

SEQ ID NO: 26517 - protein, 51 aa, Homo sapiens
  Payload ID: 5225
  Gene Symbol: EML2
  Gene Name: echinoderm microtubule associated protein like 2
  ENSP ID: ENSP00000464950
WTLEGGSLSKRQGLFEKHEKPKYVLCVTFLEGGDVVTGDSGGNLYVWGKGP

SEQ ID NO: 26518 - protein, 145 aa, Homo sapiens
  Payload ID: 5225
  Gene Symbol: EML2
  Gene Name: echinoderm microtubule associated protein like 2
  ENSP ID: ENSP00000465339
MSSFGAGKTKEVIFSVAWPSTQIWSPSPRDRWREPLRKGSRCRPTCASGTQFPSPPYTCWAWGCLTEPCAVWASPNLMEATCCVQWMNPMITCSRCGTGPRRPRWWMSSAPMRLYWWPPSTPRTPLCLSPAGNLTSTSGPWRGAA

SEQ ID NO: 26519 - protein, 223 aa, Homo sapiens
  Payload ID: 5225
  Gene Symbol: EML2
  Gene Name: echinoderm microtubule associated protein like 2
  ENSP ID: ENSP00000465607
IATGQVAGTTKEGKPLPPHVRIWDSVSLSTLHVLGLGVFDRAVCCVGFSKSCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQ

SEQ ID NO: 26520 - protein, 225 aa, Homo sapiens
  Payload ID: 5225
  Gene Symbol: EML2
  Gene Name: echinoderm microtubule associated protein like 2
  ENSP ID: ENSP00000465786
MFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFE

SEQ ID NO: 26521 - protein, 76 aa, Homo sapiens
  Payload ID: 5225
  Gene Symbol: EML2
  Gene Name: echinoderm microtubule associated protein like 2
  ENSP ID: ENSP00000465885
  MOD_RES (1)..(1): Any amino acid
XGRKVSRLGKCSGHSSFITHLDWAQDSSCFVTNSGDYEILYLEMGFHHLGQAGLELLTSGDPARCCGSCCLLGLQT

SEQ ID NO: 26522 - protein, 73 aa, Homo sapiens
  Payload ID: 5225
  Gene Symbol: EML2
  Gene Name: echinoderm microtubule associated protein like 2
  ENSP ID: ENSP00000465994
  MOD_RES (1)..(1): Any amino acid
XHQPLWSRIIEDPARSAGFHPSGSVLAVGTVTGRWLLLDTETHDLVAIHTDGNEQISVVSFSPGPFQFYHPPG

SEQ ID NO: 26523 - protein, 121 aa, Homo sapiens
  Payload ID: 5225
  Gene Symbol: EML2
  Gene Name: echinoderm microtubule associated protein like 2
  ENSP ID: ENSP00000466100
  MOD_RES (1)..(1): Any amino acid
XLCAVDESNDHMLSVWDWAKETKVVDVKVPEDFGPVRTVAEGHGDTLYVGTTRNSILQGSVHTGFSLLVQGHVEELWGLATHPSRAQFVTCGQDKLVHLWSSDSHQPLWSRIIEDPARSAG

SEQ ID NO: 26524 - protein, 133 aa, Homo sapiens
  Payload ID: 5225
  Gene Symbol: EML2
  Gene Name: echinoderm microtubule associated protein like 2
  ENSP ID: ENSP00000467941
MFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGL

SEQ ID NO: 26525 - protein, 850 aa, Homo sapiens
  Payload ID: 5225
  Gene Symbol: EML2
  Gene Name: echinoderm microtubule associated protein like 2
  Uniprot ID: O95834
  ENSP ID: ENSP00000468312
MLERRALLWQREAGPGWGDRARAGTGGAGGGCGGAMAERGPAFCGLYDTSSLLRYCNDDNLSGTSGMEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKEGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEDPARSAGFHPSGSVLAVGTVTGRWLLLDTETHDLVAIHTDGNEQISVVSFSPDGAYLAVGSHDNLVYVYTVDQGGRKVSRLGKCSGHSSFITHLDWAQDSSCFVTNSGDYEILYWDPATCKQITSADAVRNMEWATATCVLGFGVFGIWSEGADGTDINAVARSHDGKLLASADDFGKVHLFSYPCCQPRALSHKYGGHSSHVTNVAFLWDDSMALTTGGKDTSVLQWRVV

SEQ ID NO: 26526 - protein, 427 aa, Homo sapiens
  Payload ID: 5225
  Gene Symbol: EML2
  Gene Name: echinoderm microtubule associated protein like 2
  ENSP ID: ENSP00000468329
MSSFGAGKTKEVIFSVEDGSVKMFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKSNGGNLLCAVDESNDHMLSVWDWAKETKVVDVKCSNEAVLVATFHPTDPTVLITCGKSHIYFWTLEGGSLSKRQGLFEKHEKPKYVLCVTFLEGGDVVTGDSGGNLYVWGKGGNRITQAVLGAHDGGVFGLCALRDGTLVSGGGRDRRVVLWGSDYSKLQEVEVPEDFGPVRTVAEGHGDTLYVGTTRNSILQGSVHTGFSLLVQGHVEELWGLATHPSRAQFVTCGQDKLVHLWSSDSHQPLWSRIIEMAAAGHGDP

SEQ ID NO: 26527 - protein, 98 aa, Homo sapiens
  Payload ID: 5225
  Gene Symbol: EML2
  Gene Name: echinoderm microtubule associated protein like 2
  ENSP ID: ENSP00000468373
MFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTI

SEQ ID NO: 26528 - protein, 91 aa, Homo sapiens
  Payload ID: 5225
  Gene Symbol: EML2
  Gene Name: echinoderm microtubule associated protein like 2
  ENSP ID: ENSP00000468383
PLPPHVRIWDSVSLSTLHVLGLGVFDRAVCCVGFSKSNGGNLLCAVDESNDHMLSVWDWAKETKVVDVKAGVQWHNLGSLQPPPPRFQRFS

SEQ ID NO: 26529 - protein, 148 aa, Homo sapiens
  Payload ID: 5225
  Gene Symbol: EML2
  Gene Name: echinoderm microtubule associated protein like 2
  ENSP ID: ENSP00000468470
MFLRGRPVPMMIPDELAPTYSLDTRSELPSCRLKLEWVYGYRGRDCRANLYLLPTGEIVYFVASVAVLYSVEEQRQRHYLGHNDDIKCLAIHPDMVTIATGQVAGTTKEGKPLPPHVRIWDSVSLSTLHVLGLGVFDRAVCCVGFSKS

SEQ ID NO: 26530 - protein, 141 aa, Homo sapiens
  Payload ID: 5225
  Gene Symbol: EML2
  Gene Name: echinoderm microtubule associated protein like 2
  ENSP ID: ENSP00000468768
MEVDDRVSALEQRLQLQEDELAVLKAALADALRRLRACEEQGAALRARGTPKGRAPPRLGTTASVCQLLKGLPTRTPLNGSGPPRRVGGYATSPSSPKKEATSGRSSVRRYLSPERLASVRREDPRSRTTSSSSNCSAKKE

SEQ ID NO: 26531 - protein, 897 aa, Homo sapiens
  Payload ID: 5226
  Gene Symbol: EML3
  Gene Name: echinoderm microtubule associated protein like 3
  ENSP ID: ENSP00000278845
MDGAAGPGDGPAREALQSLSQRLRVQEQEMELVKAALAEALRLLRLQVPPSSLQGSGTPAPPGDSSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 26532 - protein, 896 aa, Homo sapiens
  Payload ID: 5226
  Gene Symbol: EML3
  Gene Name: echinoderm microtubule associated protein like 3
  Uniprot ID: Q32P44
  ENSP ID: ENSP00000378254
MDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 26533 - protein, 911 aa, Homo sapiens
  Payload ID: 5226
  Gene Symbol: EML3
  Gene Name: echinoderm microtubule associated protein like 3
  ENSP ID: ENSP00000378256
  MOD_RES (1)..(1): Any amino acid
XDGPAREALQSLSQRLRVQEQEMELVKAALAEALRLLRLQVPPSSLQGSGTPAPPGDSSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYVPVRSCQGAEPHVRGPRQPRDQRPIHARRLAPRLAGRQGRQHLPVASAGRWGRGAGARHALSNPLPVPRLLPRRLIAAWRDRLARRRGPAPPCPSLAQSPTTRGRLFPGLTSRHSRSRIFLEGANGAPAHTV

SEQ ID NO: 26534 - protein, 137 aa, Homo sapiens
  Payload ID: 5226
  Gene Symbol: EML3
  Gene Name: echinoderm microtubule associated protein like 3
  ENSP ID: ENSP00000409611
ILYWDVAGGCKQLKNRYESRDREWATYTCVLGFHVYVPVRSCQGEAAGIAGVGPVGPRAQPPPQLFPPAQAPSRMYGGHGSHVTSVRFTHDDSHLVSLGGKDASIFQWRVLGAGGAGPAPATPSRTPSLSPASSLDV

SEQ ID NO: 26535 - protein, 113 aa, Homo sapiens
  Payload ID: 5226
  Gene Symbol: EML3
  Gene Name: echinoderm microtubule associated protein like 3
  ENSP ID: ENSP00000411572
MELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRP

SEQ ID NO: 26536 - protein, 194 aa, Homo sapiens
  Payload ID: 5226
  Gene Symbol: EML3
  Gene Name: echinoderm microtubule associated protein like 3
  Uniprot ID: Q32P44
  ENSP ID: ENSP00000431752
MELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTAASAEALQEGNLLRQPVSAVREHREPWGKRPPLQPWGPWISEEQLQFGRHLSEDVPSRAPHYHVHPVWHPQP

SEQ ID NO: 26537 - protein, 679 aa, Homo sapiens
  Payload ID: 5226
  Gene Symbol: EML3
  Gene Name: echinoderm microtubule associated protein like 3
  ENSP ID: ENSP00000433417
MFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 26538 - protein, 127 aa, Homo sapiens
  Payload ID: 5226
  Gene Symbol: EML3
  Gene Name: echinoderm microtubule associated protein like 3
  ENSP ID: ENSP00000433706
MELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNS

SEQ ID NO: 26539 - protein, 917 aa, Homo sapiens
  Payload ID: 5226
  Gene Symbol: EML3
  Gene Name: echinoderm microtubule associated protein like 3
  Uniprot ID: Q32P44
  ENSP ID: ENSP00000434513
MDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYVPVRSCQGAEPHVRGPRQPRDQRPIHARRLAPRLAGRQGRQHLPVASAGRWGRGAGARHALSNPLPVPRLLPRRLIAAWRDRLARRRGPAPPCPSLAQSPTTRGRLFPGLTSRHSRSRIFLEGANGAPAHTV

SEQ ID NO: 26540 - protein, 889 aa, Homo sapiens
  Payload ID: 5226
  Gene Symbol: EML3
  Gene Name: echinoderm microtubule associated protein like 3
  ENSP ID: ENSP00000435064
MELVKAALAEALRLLRLQVPPSSLQGSGTPAPPGDSSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYVPVRSCQGAEPHVRGPRQPRDQRPIHARRLAPRLAGRQGRQHLPVASAGRWGRGAGARHALSNPLPVPRLLPRRLIAAWRDRLARRRGPAPPCPSLAQSPTTRGRLFPGLTSRHSRSRIFLEGANGAPAHTV

SEQ ID NO: 26541 - protein, 128 aa, Homo sapiens
  Payload ID: 5226
  Gene Symbol: EML3
  Gene Name: echinoderm microtubule associated protein like 3
  ENSP ID: ENSP00000435832
MELVKAALAEALRLLRLQVPPSSLQGSGTPAPPGDSSLAAPPGLPPTCTPSLVSRGTQTETEVELKSSPGPPGLSNGPPAPQGASEEPSGTQSEGGGSSSSGAGSPGPPGILRPLQPPQRADTPRRNS

SEQ ID NO: 26542 - protein, 981 aa, Homo sapiens
  Payload ID: 5227
  Gene Symbol: EML4
  Gene Name: echinoderm microtubule associated protein like 4
  Uniprot ID: Q9HC35
  ENSP ID: ENSP00000320663
MDGFAGSLDDSISAASTSDVQDRLSALESRVQQQEDEITVLKAALADVLRRLAISEDHVASVKKSVSSKGQPSPRAVIPMSCITNGSGANRKPSHTSAVSIAGKETLSSAAKSGTEKKKEKPQGQREKKEESHSNDQSPQIRASPSPQPSSQPLQIHRQTPESKNATPTKSIKRPSPAEKSHNSWENSDDSRNKLSKIPSTPKLIPKVTKTADKHKDVIINQEGEYIKMFMRGRPITMFIPSDVDNYDDIRTELPPEKLKLEWAYGYRGKDCRANVYLLPTGKIVYFIASVVVLFNYEERTQRHYLGHTDCVKCLAIHPDKIRIATGQIAGVDKDGRPLQPHVRVWDSVTLSTLQIIGLGTFERGVGCLDFSKADSGVHLCIIDDSNEHMLTVWDWQKKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGGKDRKIILWDHDLNPEREIEVPDQYGTIRAVAEGKADQFLVGTSRNFILRGTFNDGFQIEVQGHTDELWGLATHPFKDLLLTCAQDRQVCLWNSMEHRLEWTRLVDEPGHCADFHPSGTVVAIGTHSGRWFVLDAETRDLVSIHTDGNEQLSVMRYSIDGTFLAVGSHDNFIYLYVVSENGRKYSRYGRCTGHSSYITHLDWSPDNKYIMSNSGDYEILYWDIPNGCKLIRNRSDCKDIDWTTYTCVLGFQVFGVWPEGSDGTDINALVRSHNRKVIAVADDFCKVHLFQYPCSKAKAPSHKYSAHSSHVTNVSFTHNDSHLISTGGKDMSIIQWKLVEKLSLPQNETVADTTLTKAPVSSTESVIQSNTPTPPPSQPLNETAEEESRISSSPTLLENSLEQTVEPSEDHSEEESEEGSGDLGEPLYEEPCNEISKEQAKATLLEDQQDPSPSS

SEQ ID NO: 26543 - protein, 992 aa, Homo sapiens
  Payload ID: 5227
  Gene Symbol: EML4
  Gene Name: echinoderm microtubule associated protein like 4
  ENSP ID: ENSP00000384939
MDGFAGSLDDSISAASTSDVQDRLSALESRVQQQEDEITVLKAALADVLRRLAISEDHVASVKKSVSSKGQPSPRAVIPMSCITNGSGANRKPSHTSAVSIAGKETLSSAAKSGTEKKKEKPQGQREKKEESHSNDQSPQIRASPSPQPSSQPLQIHRQTPESKNATPTKSIKRPSPAEKSHNSWENSDDSRNKLSKIPSTPKLIPKVTKTADKHKDVIINQAKMSTREKNSQEGEYIKMFMRGRPITMFIPSDVDNYDDIRTELPPEKLKLEWAYGYRGKDCRANVYLLPTGKIVYFIASVVVLFNYEERTQRHYLGHTDCVKCLAIHPDKIRIATGQIAGVDKDGRPLQPHVRVWDSVTLSTLQIIGLGTFERGVGCLDFSKADSGVHLCIIDDSNEHMLTVWDWQKKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGGKDRKIILWDHDLNPEREIEVPDQYGTIRAVAEGKADQFLVGTSRNFILRGTFNDGFQIEVQGHTDELWGLATHPFKDLLLTCAQDRQVCLWNSMEHRLEWTRLVDEPGHCADFHPSGTVVAIGTHSGRWFVLDAETRDLVSIHTDGNEQLSVMRYSIDGTFLAVGSHDNFIYLYVVSENGRKYSRYGRCTGHSSYITHLDWSPDNKYIMSNSGDYEILYWDIPNGCKLIRNRSDCKDIDWTTYTCVLGFQVFGVWPEGSDGTDINALVRSHNRKVIAVADDFCKVHLFQYPCSKAKAPSHKYSAHSSHVTNVSFTHNDSHLISTGGKDMSIIQWKLVEKLSLPQNETVADTTLTKAPVSSTESVIQSNTPTPPPSQPLNETAEEESRISSSPTLLENSLEQTVEPSEDHSEEESEEGSGDLGEPLYEEPCNEISKEQAKATLLEDQQDPSPSS

SEQ ID NO: 26544 - protein, 923 aa, Homo sapiens
  Payload ID: 5227
  Gene Symbol: EML4
  Gene Name: echinoderm microtubule associated protein like 4
  Uniprot ID: Q9HC35
  ENSP ID: ENSP00000385059
MDGFAGSLDDSISAASTSDVQDRLSALESRVQQQEDEITVLKAALADVLRRLAISEDHVASVKKSVSSKGQPSPRAVIPMSCITNGSGANRKPSHTSAVSIAGKETLSSAAKSIKRPSPAEKSHNSWENSDDSRNKLSKIPSTPKLIPKVTKTADKHKDVIINQEGEYIKMFMRGRPITMFIPSDVDNYDDIRTELPPEKLKLEWAYGYRGKDCRANVYLLPTGKIVYFIASVVVLFNYEERTQRHYLGHTDCVKCLAIHPDKIRIATGQIAGVDKDGRPLQPHVRVWDSVTLSTLQIIGLGTFERGVGCLDFSKADSGVHLCIIDDSNEHMLTVWDWQKKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGGKDRKIILWDHDLNPEREIEVPDQYGTIRAVAEGKADQFLVGTSRNFILRGTFNDGFQIEVQGHTDELWGLATHPFKDLLLTCAQDRQVCLWNSMEHRLEWTRLVDEPGHCADFHPSGTVVAIGTHSGRWFVLDAETRDLVSIHTDGNEQLSVMRYSIDGTFLAVGSHDNFIYLYVVSENGRKYSRYGRCTGHSSYITHLDWSPDNKYIMSNSGDYEILYWDIPNGCKLIRNRSDCKDIDWTTYTCVLGFQVFGVWPEGSDGTDINALVRSHNRKVIAVADDFCKVHLFQYPCSKAKAPSHKYSAHSSHVTNVSFTHNDSHLISTGGKDMSIIQWKLVEKLSLPQNETVADTTLTKAPVSSTESVIQSNTPTPPPSQPLNETAEEESRISSSPTLLENSLEQTVEPSEDHSEEESEEGSGDLGEPLYEEPCNEISKEQAKATLLEDQQDPSPSS

SEQ ID NO: 26545 - protein, 1969 aa, Homo sapiens
  Payload ID: 5228
  Gene Symbol: EML5
  Gene Name: echinoderm microtubule associated protein like 5
  Uniprot ID: Q05BV3
  ENSP ID: ENSP00000370039
MAARSAPSCHLRLEWVYGYRGHQCRNNLYYTAAKEIVYFVAGVGVVYSPREHRQKFYRGHSDDIISLALHPERVLVATGQVGKEPYICIWDSYTVQTISVLKDVHTHGIACLAFDLDGQRLVSVGLDSKNAVCVWDWKRGKMLSMAPGHTDRIFDISWDLYQPNKLVSCGVKHIKFWSLCGNALTPKRGVFGKTGDLQTILCLACARDELTYSGALNGDIYVWKGINLIRTIQGAHAAGIFSMNACEEGFATGGRDGCIRLWDLTFKPITVIDLRETDQGYKGLSVRSVCWRGDHILVGTQDSEIFEIVVQERNKPFLIMQGHCEGELWALAVHPTKPLAVTGSDDRSVRIWSLVDHALIARCNMEEPIRCAAVNADGIHLALGMKDGSFTVLRVRDMTEVVHIKDRKEAIHELKYSPDGTYLAVGCNDSSVDIYGVAQRYKKVGECLGSLSFITHLDWSSDSRYLQTNDGNGKRLFYRMPGGKEVTSTEEIKGVHWASWTCVSGLEVNGIWPKYSDINDINSVDGNYIGQVLVTADDYGIIKLFRYPCLRKGAKFRKYIGHSAHVTNVRWSHDYQWVISIGGADHSVFQWKFIPERKLKDAVHIAPQESLADSHSDESDSDLSDVPELDSEIEQETQLTYRRQVYKEDLPQLKEQCKEKQKSATSKRRERAPGNSIRLHFVHGYRGYDCRSNLFYTQIGEIVYHVAAVGVIYNRQQNTQRFYLGHDDDILCLTIHPLKDYVATGQVGRDPSIHIWDTETIKPLSILKGHHQYGVSAVDFSADGKRLASVGIDDSHTVVLWDWKKGEKLSIARGSKDKIFVVKMNPYVPDKLITAGIKHMKFWRKAGGGLIGRKGYIGTLGKNDTMMCAVYGWTEEMAFSGTSTGDVCIWRDIFLVKTVKAHDGPVFSMHALEKGFVTGGKDGIVALWDDSFERCLKTYAIKRAALAPGSKGLLLEDNPSIRAISLGHGHILVGTKNGEILEVDKSGPITLLVQGHMEGEVWGLATHPYLPICATVSDDKTLRIWDLSPSHCMLAVRKLKKGGRCCCFSPDGKALAVGLNDGSFLMANADTLEDLVSFHHRKDMISDIRFSPGSGKYLAVASHDSFIDIYNVMSSKRVGICKGATSYITHIDWDIRGKLLQVNTGAKEQLFFEAPRGKKQTIPSVEVEKIAWASWTSVLGLCCEGIWPVIGEVTDVTASCLTSDKMVLATGDDLGFVKLFRYPTKGKFGKFKRYVAHSTHVTNVRWTYDDSMLVTLGGTDMSLMVWTNEMEGYREKRPCDSEESDIDSEEDGGYDSDVTRENEISYTIRALSTNIRPMLGIKPHLQQKEPSIDERPPVSRAPPQPEKLQTNNVGKKKRPIEDLVLELIFGYRGRDCRNNVHYLNDGDDIIYHTASVGILHNVATGSQSFYQEHNDDILCLTVNQHPKFINIVATGQVGDSADMSATAPSIHIWDAMNKQTLSILRCYHSKGVCSVSFSATGKLLLSVGLDPEHTITIWRWQEGAKIASRAGHNQRIFVAEFRPDSDTQFVSVGVKHVKFWTLAGRALLSKKGLLSTLEDARMQTMLAIAFGANNLTFTGTISGDVCVWKDHILCRIVARAHNGPVFAMYTTLRDGLIVTGGKERPSKEGGAVKLWDQELRRCRAFRLETGQATDCVRSVCRGKGKILVGTRNAEIIEVGEKNAACNILVNGHVDGPIWGLATHPSRDFFLSAAEDGTVRLWDIADKKMLNKVNLGHAARTVCYSPEGDMVAIGMKNGEFIILLVSSLKIWGKKRDRRCAIHDIRFSPDSRYLAVGSSENSVDFYDLTLGPTLNRISYCKDIPSFVIQMDFSADSSYLQVSSGCYKRHVYEVPSGKHLMDHAAIDRITWATWTSILGDEVLGIWSRHAEKADVNCACVSHSGISLVTGDDFGMVKLFDFPCPEKFAKHKRFLGHSPHVTNIRFTSGDRHVVSAGGDDCSLFVWKCVHTPH

SEQ ID NO: 26546 - protein, 60 aa, Homo sapiens
  Payload ID: 5228
  Gene Symbol: EML5
  Gene Name: echinoderm microtubule associated protein like 5
  ENSP ID: ENSP00000450965
ISDIRFSPGSGKYLAVASHDSFIDIYNVMSSKRVGICKGATSYITHIDWDIRAFTGQHWC

SEQ ID NO: 26547 - protein, 1977 aa, Homo sapiens
  Payload ID: 5228
  Gene Symbol: EML5
  Gene Name: echinoderm microtubule associated protein like 5
  Uniprot ID: Q05BV3
  ENSP ID: ENSP00000451998
MAARSAPSCHLRLEWVYGYRGHQCRNNLYYTAAKEIVYFVAGVGVVYSPREHRQKFYRGHSDDIISLALHPERVLVATGQVGKEPYICIWDSYTVQTISVLKDVHTHGIACLAFDLDGQRLVSVGLDSKNAVCVWDWKRGKMLSMAPGHTDRIFDISWDLYQPNKLVSCGVKHIKFWSLCGNALTPKRGVFGKTGDLQTILCLACARDELTYSGALNGDIYVWKGINLIRTIQGAHAAGIFSMNACEEGFATGGRDGCIRLWDLTFKPITVIDLRETDQGYKGLSVRSVCWRGDHILVGTQDSEIFEIVVQERNKPFLIMQGHCEGELWALAVHPTKPLAVTGSDDRSVRIWSLVDHALIARCNMEEPIRCAAVNADGIHLALGMKDGSFTVLRVRDMTEVVHIKDRKEAIHELKYSPDGTYLAVGCNDSSVDIYGVAQRYKKVGECLGSLSFITHLDWSSDSRYLQTNDGNGKRLFYRMPGGKEVTSTEEIKGVHWASWTCVSGLEVNGIWPKYSDINDINSVDGNYIGQVLVTADDYGIIKLFRYPCLRKGAKFRKYIGHSAHVTNVRWSHDYQWVISIGGADHSVFQWKFIPERKLKDAVHIAPQESLADSHSDESDSDLSDVPELDSEIEQETQLTYRRQVYKEDLPQLKEQCKEKQKSATSKRRERAPGNSIRLHFVHGYRGYDCRSNLFYTQIGEIVYHVAAVGVIYNRQQNTQRFYLGHDDDILCLTIHPLKDYVATGQVGRDPSIHIWDTETIKPLSILKGHHQYGVSAVDFSADGKRLASVGIDDSHTVVLWDWKKGEKLSIARGSKDKIFVVKMNPYVPDKLITAGIKHMKFWRKAGGGLIGRKGYIGTLGKNDTMMCAVYGWTEEMAFSGTSTGDVCIWRDIFLVKTVKAHDGPVFSMHALEKGFVTGGKDGIVALWDDSFERCLKTYAIKRAALAPGSKGLLLEDNPSIRAISLGHGHILVGTKNGEILEVDKSGPITLLVQGHMEGEVWGLATHPYLPICATVSDDKTLRIWDLSPSHCMLAVRKLKKGGRCCCFSPDGKALAVGLNDGSFLMANADTLEDLVSFHHRKDMISDIRFSPGSGKYLAVASHDSFIDIYNVMSSKRVGICKGATSYITHIDWDIRGKLLQVNTGAKEQLFFEAPRGKKQTIPSVEVEKIAWASWTSVLGLCCEGIWPVIGEVTDVTASCLTSDKMVLATGDDLGFVKLFRYPTKGKFGKFKRYVAHSTHVTNVRWTYDDSMLVTLGGTDMSLMVWTNEMEGYREKRPCDSEESDIDSEEDGGYDSDVTRENEISYTIRALSTNIRPMLGIKPHLQQKEPSIDERQGVVRGSRPPVSRAPPQPEKLQTNNVGKKKRPIEDLVLELIFGYRGRDCRNNVHYLNDGDDIIYHTASVGILHNVATGSQSFYQEHNDDILCLTVNQHPKFINIVATGQVGDSADMSATAPSIHIWDAMNKQTLSILRCYHSKGVCSVSFSATGKLLLSVGLDPEHTITIWRWQEGAKIASRAGHNQRIFVAEFRPDSDTQFVSVGVKHVKFWTLAGRALLSKKGLLSTLEDARMQTMLAIAFGANNLTFTGTISGDVCVWKDHILCRIVARAHNGPVFAMYTTLRDGLIVTGGKERPSKEGGAVKLWDQELRRCRAFRLETGQATDCVRSVCRGKGKILVGTRNAEIIEVGEKNAACNILVNGHVDGPIWGLATHPSRDFFLSAAEDGTVRLWDIADKKMLNKVNLGHAARTVCYSPEGDMVAIGMKNGEFIILLVSSLKIWGKKRDRRCAIHDIRFSPDSRYLAVGSSENSVDFYDLTLGPTLNRISYCKDIPSFVIQMDFSADSSYLQVSSGCYKRHVYEVPSGKHLMDHAAIDRITWATWTSILGDEVLGIWSRHAEKADVNCACVSHSGISLVTGDDFGMVKLFDFPCPEKFAKHKRFLGHSPHVTNIRFTSGDRHVVSAGGDDCSLFVWKCVHTPH

SEQ ID NO: 26548 - protein, 256 aa, Homo sapiens
  Payload ID: 5228
  Gene Symbol: EML5
  Gene Name: echinoderm microtubule associated protein like 5
  ENSP ID: ENSP00000452030
GLLSTLEDARMQTMLAIAFGANNLTFTGTISGDVCVWKDHILCRIVARAHNGPVFAMYTTLRDGLIVTGGKERPSKEGGAVKLWDQELRRCRAFRLETGQATDCVRSVCRGKGKILVGTRNAEIIEVGEKNAACNILVNGHVDGPIWGLATHPSRDFFLSAAEDGTVRLWDIADKMLNKVNLGHAARTVCYSPEGDMVAIGMKNGEFIILLVSSLKIWGKKRDRRCAIHDIRISYCKDIPSFVIQMDFSADSSYLQ

SEQ ID NO: 26549 - protein, 205 aa, Homo sapiens
  Payload ID: 5228
  Gene Symbol: EML5
  Gene Name: echinoderm microtubule associated protein like 5
  ENSP ID: ENSP00000452360
  MOD_RES (1)..(1): Any amino acid
XDGTYLAVGCNDSSVDIYGVAQRYKKVGECLGSLSFITHLDWSSDSRYLQTNDGNGKRLFYRMPGGKEVTSTEEIKGVHWASWTCVSGLEVNGIWPKYSDINDINSVDGNYIGQVLVTADDYGIIKLFRYPCLRKGAKFRKYIGHSAHVTNVRWSHDYQWVISIGGADHSVFQWKFIPERKLKDAVHIAPQGYIHLYLHRHLNLM

SEQ ID NO: 26550 - protein, 1958 aa, Homo sapiens
  Payload ID: 5229
  Gene Symbol: EML6
  Gene Name: echinoderm microtubule associated protein like 6
  Uniprot ID: Q6ZMW3
  ENSP ID: ENSP00000348842
MADRTAPRCQLRLEWVYGYRGHQCRNNLYYTAGKEVVYFVAGVGVVYNTREHSQKFFLGHNDDIISLALHPDKTLVATGQVGKEPYICIWDSYNVQTVSLLKDVHTHGVACLAFDSDGQRLASVGLDAKNTVCIWDWRKGKLLASATGHSDRIFDISWDPYQPNRVVSCGVKHIKFWTLCGNALTAKRGIFGKTGDLQTILCLACAKEDITYSGALNGDIYVWKGLNLVRTIQGAHSAGIFSMYACEEGFATGGRDGCIRLWDTDFKPITKIDLRETEQGYKGLSIRSVCWKADRLLAGTQDSEIFEVIVRERDKPMLILQGHCEGELWALALHPKKPLAVTGSDDRSVRLWSLADHALIARCNMEEAVRSVAFSPDGSQLALGMKDGSFIVLRVRDMTEVVHIKDRKEVIHEMKFSPDGSYLAVGSNDGPVDVYAVAQRYKKIGECSKSLSFITHIDWSLDSKYLQTNDGAGERLFYRMPSGKPLTSKEEIKGIPWASWTCVKGPEVSGIWPKYTEVTDINSVDANYNSSVLVSGDDFGLVKLFKFPCLKRGAKFRKYVGHSAHVTNVRWSHDFQWVLSTGGADHSVFQWRFIPEGVSNGMLETAPQEGGADSYSEESDSDLSDVPELDSDIEQEAQINYDRQVYKEDLPQLKQQSKEKNHAVPFLKREKAPEDSLKLQFIHGYRGYDCRNNLFYTQAGEVVYHIAAVAVVYNRQQHSQRLYLGHDDDILSLTIHPVKDYVATGQVGRDAAIHVWDTQTLKCLSLLKGQHQRGVCALDFSADGKCLVSVGLDDFHSIVFWDWKKGEKIATTRGHKDKIFVVKCNPHHVDKLVTVGIKHIKFWQQAGGGFTSKRGTFGSVGKLETMMCVSYGRMEDLVFSGAATGDIFIWKDILLLKTVKAHDGPVFAMYALDKGFVTGGKDGIVELWDDMFERCLKTYAIKRSALSTSSKGLLLEDNPSIRAITLGHGHILVGTKNGEILEIDKSGPMTLLVQGHMEGEVWGLAAHPLLPICATVSDDKTLRIWELSAQHRMLAVRKLKKGGRCCAFSPDGKALAVGLNDGSFLVVNADTVEDMVSFHHRKEMISDIKFSKDTGKYLAVASHDNFVDIYNVLTSKRVGICKGASSYITHIDWDSRGKLLQVNSGAREQLFFEAPRGKRHIIRPSEIEKIEWDTWTCVLGPTCEGIWPAHSDITDVNAASLTKDCSLLATGDDFGFVKLFSYPVKGQHARFKKYVGHSAHVTNVRWLHNDSVLLTVGGADTALMIWTREFVGTQESKLVDSEESDTDVEEDGGYDSDVAREKAIDYTTKIYAVSIREMEGTKPHQQLKEVSVEERPPVSRAAPQPEKLQKNNITKKKKLVEELALDHVFGYRGFDCRNNLHYLNDGADIIFHTAAAGIVQNLSTGSQSFYLEHTDDILCLTVNQHPKYRNVVATSQIGTTPSIHIWDAMTKHTLSMLRCFHSKGVNYINFSATGKLLVSVGVDPEHTITVWRWQEGAKVASRGGHLERIFVVEFRPDSDTQFVSVGVKHMKFWTLAGSALLYKKGVIGSLGAAKMQTMLSVAFGANNLTFTGAINGDVYVWKDHFLIRLVAKAHTGPVFTMYTTLRDGLIVTGGKERPTKEGGAVKLWDQEMKRCRAFQLETGQLVECVRSVCRGKGKILVGTKDGEIIEVGEKNAASNILIDGHMEGEIWGLATHPSKDLFISASNDGTARIWDLADKKLLNKVSLGHAARCAAYSPDGEMVAIGMKNGEFVILLVNSLKVWGKKRDRKSAIQDIRISPDNRFLAVGSSEHTVDFYDLTQGTNLNRIGYCKDIPSFVIQMDFSADGKYIQVSTGAYKRQVHEVPLGKQVTEAVVIEKITWASWTSVLGDEVIGIWPRNADKADVNCACVTHAGLNIVTGDDFGLVKLFDFPCTEKFAKHKRYFGHSAHVTNIRFSYDDKYVVSTGGDDCSVFVWRCL

SEQ ID NO: 26551 - protein, 259 aa, Homo sapiens
  Payload ID: 5230
  Gene Symbol: EVI2A
  Gene Name: ecotropic viral integration site 2A
  Uniprot ID: P22794
  ENSP ID: ENSP00000247270
MLLRSWFGNKDFQALPILARLPSMPTDMEHTGHYLHLAFLMTTVFSLSPGTKANYTRLWANSTSSWDSVIQNKTGRNQNENINTNPITPEVDYKGNSTNMPETSHIVALTSKSEQELYIPSVVSNSPSTVQSIENTSKSHGEIFKKDVCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIG

SEQ ID NO: 26552 - protein, 236 aa, Homo sapiens
  Payload ID: 5230
  Gene Symbol: EVI2A
  Gene Name: ecotropic viral integration site 2A
  Uniprot ID: P22794
  ENSP ID: ENSP00000418064
MPTDMEHTGHYLHLAFLMTTVFSLSPGTKANYTRLWANSTSSWDSVIQNKTGRNQNENINTNPITPEVDYKGNSTNMPETSHIVALTSKSEQELYIPSVVSNSPSTVQSIENTSKSHGEIFKKDVCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIG

SEQ ID NO: 26553 - protein, 236 aa, Homo sapiens; identical to SEQ ID NO: 26552
  Payload ID: 5230
  Gene Symbol: EVI2A
  Gene Name: ecotropic viral integration site 2A
  Uniprot ID: P22794
  ENSP ID: ENSP00000420557

SEQ ID NO: 26554 - protein, 448 aa, Homo sapiens
  Payload ID: 5231
  Gene Symbol: EVI2B
  Gene Name: ecotropic viral integration site 2B
  Uniprot ID: P34910
  ENSP ID: ENSP00000333779
MDPKYFILILFCGHLNNTFFSKTETITTEKQSQPTLFTSSMSQVLANSQNTTGNPLGQPTQFSDTFSGQSISPAKVTAGQPTPAVYTSSEKPEAHTSAGQPLAYNTKQPTPIANTSSQQAVFTSARQLPSARTSTTQPPKSFVYTFTQQSSSVQIPSRKQITVHNPSTQPTSTVKNSPRSTPGFILDTTSNKQTPQKNNYNSIAAILIGVLLTSMLVAIIIIVLWKCLRKPVLNDQNWAGRSPFADGETPDICMDNIRENEISTKRTSIISLTPWKPSKSTLLADDLEIKLFESSENIEDSNNPKTEKIKDQVNGTSEDSADGSTVGTAVSSSDDADLPPPPPLLDLEGQESNQSDKPTMTIVSPLPNDSTSLPPSLDCLNQDCGDHKSEIIQSFPPLDSLNLPLPPVDFMKNQEDSNLEIQCQEFSIPPNSDQDLNESLPPPPAELL

SEQ ID NO: 26555 - protein, 448 aa, Homo sapiens; identical to SEQ ID NO: 26554
  Payload ID: 5231
  Gene Symbol: EVI2B
  Gene Name: ecotropic viral integration site 2B
  Uniprot ID: P34910
  ENSP ID: ENSP00000462682

SEQ ID NO: 26556 - protein, 810 aa, Homo sapiens
  Payload ID: 5232
  Gene Symbol: EVI5
  Gene Name: ecotropic viral integration site 5
  Uniprot ID: O60447
  ENSP ID: ENSP00000359356
MVTNKMTAAFRNPSGKQVATDKVAEKLSSTLSWVKNTVSHTVSQMASQVASPSTSLHTTSSSTTLSTPALSPSSPSQLSPDDLELLAKLEEQNRLLETDSKSLRSVNGSRRNSGSSLVSSSSASSNLSHLEEDSWILWGRIVNEWEDVRKKKEKQVKELVHKGIPHHFRAIVWQLLCSAQSMPIKDQYSELLKMTSPCEKLIRRDIARTYPEHNFFKEKDSLGQEVLFNVMKAYSLVDREVGYCQGSAFIVGLLLMQMPEEEAFCVFVKLMQDYRLRELFKPSMAELGLCMYQFECMIQEHLPELFVHFQSQSFHTSMYASSWFLTIFLTTFPLPIATRIFDIFMSEGLEIVFRVGLALLQMNQAELMQLDMEGMLQHFQKVIPHQFDGVPDKLIQAAYQVKYNSKKMKKLEKEYTTIKTKEMEEQVEIKRLRTENRLLKQRIETLEKHKCSSNYNEDFVLQLEKELVQARLSEAESQCALKEMQDKVLDIEKRNNSLPDENNIARLQEELIAVKLREAEAIMGLKELRQQVKDLEEHWQRHLARTTGRWKDPPKKNAMNELQDELMTIRLREAETQAEIREIKQRMMEMETQNQINSNHLRRAEQEVISLQEKVQYLSAQNKGLLTQLSEAKRKQAEIECKNKEEVMAVRLREADSIAAVAELRQHIAELEIQKEEGKLQGQLNKSDSNQYIGELKDQIAELNHELRCLKGQRGFSGQPPFDGIHIVNHLIGDDESFHSSDEDFIDNSLQETGVGFPLHGKSGSMSLDPAVADGSESETEDSVLETRESNQVVQKERPPRRRESYSTTV

SEQ ID NO: 26557 - protein, 821 aa, Homo sapiens
  Payload ID: 5232
  Gene Symbol: EVI5
  Gene Name: ecotropic viral integration site 5
  Uniprot ID: O60447
  ENSP ID: ENSP00000440826
MVTNKMTAAFRNPSGKQVATDKVAEKLSSTLSWVKNTVSHTVSQMASQVASPSTSLHTTSSSTTLSTPALSPSSPSQLSPDDLELLAKLEEQNRLLETDSKSLRSVNGSRRNSGSSLVSSSSASSNLSHLEEDSWILWGRIVNEWEDVRKKKEKQVKELVHKGIPHHFRAIVWQLLCSAQSMPIKDQYSELLKMTSPCEKLIRRDIARTYPEHNFFKEKDSLGQEVLFNVMKAYSLVDREVGYCQGSAFIVGLLLMQMPEEEAFCVFVKLMQDYRLRELFKPSMAELGLCMYQFECMIQEHLPELFVHFQSQSFHTSMYASSWFLTIFLTTFPLPIATRIFDIFMSEGLEIVFRVGLALLQMNQAELMQLDMEGMLQHFQKVIPHQFDGVPDKLIQAAYQVKYNSKKMKKLEKEYTTIKTKEMEEQVEIKRLRTENRLLKQRIETLEKESASLADRLIQHKCSSNYNEDFVLQLEKELVQARLSEAESQCALKEMQDKVLDIEKRNNSLPDENNIARLQEELIAVKLREAEAIMGLKELRQQVKDLEEHWQRHLARTTGRWKDPPKKNAMNELQDELMTIRLREAETQAEIREIKQRMMEMETQNQINSNHLRRAEQEVISLQEKVQYLSAQNKGLLTQLSEAKRKQAEIECKNKEEVMAVRLREADSIAAVAELRQHIAELEIQKEEGKLQGQLNKSDSNQYIGELKDQIAELNHELRCLKGQRGFSGQPPFDGIHIVNHLIGDDESFHSSDEDFIDNSLQETGVGFPLHGKSGSMSLDPAVADGSESETEDSVLETRESNQVVQKERPPRRRESYSTTV

SEQ ID NO: 26558 - protein, 794 aa, Homo sapiens
  Payload ID: 5233
  Gene Symbol: EVI5L
  Gene Name: ecotropic viral integration site 5-like
  Uniprot ID: Q96CN4
  ENSP ID: ENSP00000270530
MASPTLSPDSSSQEALSAPTCSPTSDSENLSPDELELLAKLEEQNRLLEADSKSMRSMNGSRRNSGSSLVSSSSASSNLSHLEEDTWILWGRIANEWEEWRRRKEKLLKELIRKGIPHHFRAIVWQLLCSATDMPVKNQYSELLKMSSPCEKLIRRDIARTYPEHEFFKGQDSLGQEVLFNVMKAYSLVDREVGYCQGSAFIVGLLLMQMPEEEAFCVFVRLMQEYRLRELFKPSMAELGLCIYQFEYMLQEQLPDLNTHFRSQSFHTSMYASSWFLTLFLTTFPLPVATRVFDIFMYEGLEIVFRVGLALLQVNQAELMQLDMEGMSQYFQRVIPHQFDSCPDKLVLKAYQVKYNPKKMKRLEKEYAAMKSKEMEEQIEIKRLRTENRLLKQRIETLEKGQVTRAQEAEENYVIKRELAVVRQQCSSAAEDLQKAQSTIRQLQEQQENPRLTEDFVSHLETELEQSRLRETETLGALREMQDKVLDMEKRNSSLPDENNVAQLQEELKALKVREGQAVASTRELKLQLQELSDTWQAHLARGGRWKESPRKLVVGELQDELMSVRLREAQALAEGRELRQRVVELETQDHIHRNLLNRVEAERAALQEKLQYLAAQNKGLQTQLSESRRKQAEAECKSKEEVMAVRLREADSMAAVAEMRQRIAELEIQREEGRIQGQLNHSDSSQYIRELKDQIEELKAEVRLLKGPPPFEDPLAFDGLSLARHLDEDSLPSSDEELLGVGVGAALQDALYPLSPRDARFFRRLERPAKDSEGSSDSDADELAAPYSQGLDN

SEQ ID NO: 26559 - protein, 805 aa, Homo sapiens
  Payload ID: 5233
  Gene Symbol: EVI5L
  Gene Name: ecotropic viral integration site 5-like
  Uniprot ID: Q96CN4
  ENSP ID: ENSP00000445905
MASPTLSPDSSSQEALSAPTCSPTSDSENLSPDELELLAKLEEQNRLLEADSKSMRSMNGSRRNSGSSLVSSSSASSNLSHLEEDTWILWGRIANEWEEWRRRKEKLLKELIRKGIPHHFRAIVWQLLCSATDMPVKNQYSELLKMSSPCEKLIRRDIARTYPEHEFFKGQDSLGQEVLFNVMKAYSLVDREVGYCQGSAFIVGLLLMQMPEEEAFCVFVRLMQEYRLRELFKPSMAELGLCIYQFEYMLQEQLPDLNTHFRSQSFHTSMYASSWFLTLFLTTFPLPVATRVFDIFMYEGLEIVFRVGLALLQVNQAELMQLDMEGMSQYFQRVIPHQFDSCPDKLVLKAYQVKYNPKKMKRLEKEYAAMKSKEMEEQIEIKRLRTENRLLKQRIETLEKESAALADRLIQGQVTRAQEAEENYVIKRELAVVRQQCSSAAEDLQKAQSTIRQLQEQQENPRLTEDFVSHLETELEQSRLRETETLGALREMQDKVLDMEKRNSSLPDENNVAQLQEELKALKVREGQAVASTRELKLQLQELSDTWQAHLARGGRWKESPRKLVVGELQDELMSVRLREAQALAEGRELRQRVVELETQDHIHRNLLNRVEAERAALQEKLQYLAAQNKGLQTQLSESRRKQAEAECKSKEEVMAVRLREADSMAAVAEMRQRIAELEIQREEGRIQGQLNHSDSSQYIRELKDQIEELKAEVRLLKGPPPFEDPLAFDGLSLARHLDEDSLPSSDEELLGVGVGAALQDALYPLSPRDARFFRRLERPAKDSEGSSDSDADELAAPYSQGLDN

SEQ ID NO: 26560 - protein, 139 aa, Homo sapiens
  Payload ID: 5233
  Gene Symbol: EVI5L
  Gene Name: ecotropic viral integration site 5-like
  ENSP ID: ENSP00000470145
FVSHLETELEQSRLRETETLGALREMQDKVLDMEKRNSSLPDENNVAQLQEELKALKVREGQAVASTRELKLQLQELSDTWQDQIEELKAEVRLLKGPPPFEDPLAFDGLSLARHLDEDSLPSSDEELLGVGVGAALQD

SEQ ID NO: 26561 - protein, 177 aa, Homo sapiens
  Payload ID: 5233
  Gene Symbol: EVI5L
  Gene Name: ecotropic viral integration site 5-like
  ENSP ID: ENSP00000472181
VFVRLMQEYRLRELFKPSMAELGLCIYQFEYMLQEQLPDLNTHFRSQSFHTSMYASSWFLTLFLTTFPLPVATRVFDIFMYEGLEIVFRVGLALLQVNQAELMQLDMEGMSQYFQRVIPHQFDSCPDKLVLKAYQVKYNPKKMKRLEKEYAAMKSKEMEEQIEIKASCERLPRLTPR

SEQ ID NO: 26562 - protein, 296 aa, Homo sapiens
  Payload ID: 5234
  Gene Symbol: ECSIT
  Gene Name: ECSIT signalling integrator
  Uniprot ID: Q9BQ95
  ENSP ID: ENSP00000252440
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGSGRDAGGVEPLLPDAAGPGVCEEWLGQLRV

SEQ ID NO: 26563 - protein, 431 aa, Homo sapiens
  Payload ID: 5234
  Gene Symbol: ECSIT
  Gene Name: ECSIT signalling integrator
  Uniprot ID: Q9BQ95
  ENSP ID: ENSP00000270517
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 26564 - protein, 217 aa, Homo sapiens
  Payload ID: 5234
  Gene Symbol: ECSIT
  Gene Name: ECSIT signalling integrator
  Uniprot ID: Q9BQ95
  ENSP ID: ENSP00000412712
MSWVQATLLARGLCRAWGGTCGAALTGTSISQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 26565 - protein, 223 aa, Homo sapiens
  Payload ID: 5234
  Gene Symbol: ECSIT
  Gene Name: ECSIT signalling integrator
  ENSP ID: ENSP00000462957
MREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRS

SEQ ID NO: 26566 - protein, 59 aa, Homo sapiens
  Payload ID: 5234
  Gene Symbol: ECSIT
  Gene Name: ECSIT signalling integrator
  ENSP ID: ENSP00000464783
  MOD_RES (1)..(1): Any amino acid
XMREYGVERDLAVYNQLLNIFPKEVFRPRNIIQRIFVHYPRQQECGIAVLEQMENHAQV

SEQ ID NO: 26567 - protein, 71 aa, Homo sapiens
  Payload ID: 5234
  Gene Symbol: ECSIT
  Gene Name: ECSIT signalling integrator
  ENSP ID: ENSP00000465162
  MOD_RES (1)..(1): Any amino acid
XVNPFPVPRDLPQDPVELAMFGLRHMEPDLSARVTIYQAPCAAPDAARLPPQRFLCPKTQQVQQIPPSPTS

SEQ ID NO: 26568 - protein, 102 aa, Homo sapiens
  Payload ID: 5234
  Gene Symbol: ECSIT
  Gene Name: ECSIT signalling integrator
  ENSP ID: ENSP00000465181
MREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRD

SEQ ID NO: 26569 - protein, 24 aa, Homo sapiens
  Payload ID: 5234
  Gene Symbol: ECSIT
  Gene Name: ECSIT signalling integrator
  ENSP ID: ENSP00000466415
MSWVQATLLARGLCRAWGGTCGAA

SEQ ID NO: 26570 - protein, 296 aa, Homo sapiens
  Payload ID: 5234
  Gene Symbol: ECSIT
  Gene Name: ECSIT signalling integrator
  Uniprot ID: Q9BQ95
  ENSP ID: ENSP00000466559
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVELTCCPRRRGKWKRRRRSGTSTTRCSWTWSM

SEQ ID NO: 26571 - protein, 267 aa, Homo sapiens
  Payload ID: 5234
  Gene Symbol: ECSIT
  Gene Name: ECSIT signalling integrator
  ENSP ID: ENSP00000466762
MREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGKSESMGAAKSLTLPRPCQVLAGPRLGSLGLWAESLAGHRACMSPHQESRVPISRPPWPATIQPGLSLLRAPSPCGSATSVCITTSSELTCCPRRRGKWKRRRRSGTSTTRCSWTWSM

SEQ ID NO: 26572 - protein, 227 aa, Homo sapiens
  Payload ID: 5234
  Gene Symbol: ECSIT
  Gene Name: ECSIT signalling integrator
  ENSP ID: ENSP00000467436
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELA

SEQ ID NO: 26573 - protein, 82 aa, Homo sapiens
  Payload ID: 5234
  Gene Symbol: ECSIT
  Gene Name: ECSIT signalling integrator
  ENSP ID: ENSP00000468783
MSWVQATLLARGLCRAWGGTCGAALTGTSISQVPLPKDSTGAADPPQPHIVGSGRDAGGVEPLLPDAAGPGVCEEWLGQLRV

SEQ ID NO: 26574 - protein, 589 aa, Homo sapiens
  Payload ID: 5235
  Gene Symbol: ENC1
  Gene Name: ectodermal-neural cortex 1 (with BTB domain)
  Uniprot ID: O14682
  ENSP ID: ENSP00000306356
MSVSVHENRKSRASSGSINIYLFHKSSYADSVLTHLNLLRQQRLFTDVLLHAGNRTFPCHRAVLAACSRYFEAMFSGGLKESQDSEVNFDNSIHPEVLELLLDYAYSSRVIINEENAESLLEAGDMLEFQDIRDACAEFLEKNLHPTNCLGMLLLSDAHQCTKLYELSWRMCLSNFQTIRKNEDFLQLPQDMVVQLLSSEELETEDERLVYESAINWISYDLKKRYCYLPELLQTVRLALLPAIYLMENVAMEELITKQRKSKEIVEEAIRCKLKILQNDGVVTSLCARPRKTGHALFLLGGQTFMCDKLYLVDQKAKEIIPKADIPSPRKEFSACAIGCKVYITGGRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 26575 - protein, 49 aa, Homo sapiens
  Payload ID: 5235
  Gene Symbol: ENC1
  Gene Name: ectodermal-neural cortex 1 (with BTB domain)
  ENSP ID: ENSP00000422943
MSVSVHENRKSRASSGSINIYLFHKSSYADSVLTHLNLLRQQRLFTDVL

SEQ ID NO: 26576 - protein, 516 aa, Homo sapiens
  Payload ID: 5235
  Gene Symbol: ENC1
  Gene Name: ectodermal-neural cortex 1 (with BTB domain)
  Uniprot ID: O14682
  ENSP ID: ENSP00000423804
MFSGGLKESQDSEVNFDNSIHPEVLELLLDYAYSSRVIINEENAESLLEAGDMLEFQDIRDACAEFLEKNLHPTNCLGMLLLSDAHQCTKLYELSWRMCLSNFQTIRKNEDFLQLPQDMVVQLLSSEELETEDERLVYESAINWISYDLKKRYCYLPELLQTVRLALLPAIYLMENVAMEELITKQRKSKEIVEEAIRCKLKILQNDGVVTSLCARPRKTGHALFLLGGQTFMCDKLYLVDQKAKEIIPKADIPSPRKEFSACAIGCKVYITGGRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 26577 - protein, 4 aa, Homo sapiens
  Payload ID: 5235
  Gene Symbol: ENC1
  Gene Name: ectodermal-neural cortex 1 (with BTB domain)
  ENSP ID: ENSP00000426889
MSVS

SEQ ID NO: 26578 - protein, 589 aa, Homo sapiens; identical to SEQ ID NO: 26574
  Payload ID: 5235
  Gene Symbol: ENC1
  Gene Name: ectodermal-neural cortex 1 (with BTB domain)
  Uniprot ID: O14682
  ENSP ID: ENSP00000446289

SEQ ID NO: 26579 - protein, 589 aa, Homo sapiens; identical to SEQ ID NO: 26574
  Payload ID: 5235
  Gene Symbol: ENC1
  Gene Name: ectodermal-neural cortex 1 (with BTB domain)
  Uniprot ID: O14682
  ENSP ID: ENSP00000479101

SEQ ID NO: 26580 - protein, 147 aa, Homo sapiens
  Payload ID: 5236
  Gene Symbol: EDA
  Gene Name: ectodysplasin A
  Uniprot ID: Q92838
  ENSP ID: ENSP00000340611
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQVSHLVGAAAAPSPRG

SEQ ID NO: 26581 - protein, 391 aa, Homo sapiens
  Payload ID: 5236
  Gene Symbol: EDA
  Gene Name: ectodysplasin A
  Uniprot ID: Q92838
  ENSP ID: ENSP00000363680
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 26582 - protein, 389 aa, Homo sapiens
  Payload ID: 5236
  Gene Symbol: EDA
  Gene Name: ectodysplasin A
  Uniprot ID: Q92838
  ENSP ID: ENSP00000363681
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVYYINFTDFASYEVVVDEKPFLQCTRSIETGKTNYNTCYTAGVCLLKARQKIAVKMVHADISINMSKHTTFFGAIRLGEAPAS

SEQ ID NO: 26583 - protein, 136 aa, Homo sapiens
  Payload ID: 5236
  Gene Symbol: EDA
  Gene Name: ectodysplasin A
  ENSP ID: ENSP00000423037
MALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSG

SEQ ID NO: 26584 - protein, 386 aa, Homo sapiens
  Payload ID: 5236
  Gene Symbol: EDA
  Gene Name: ectodysplasin A
  Uniprot ID: Q92838
  ENSP ID: ENSP00000432585
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNGGVLNDWSRITMNPKVFKLHPRSGELEVLVDGTYFIYSQVYYINFTDFASYEVVVDEKPFLQCTRSIETGKTNYNTCYTAGVCLLKARQKIAVKMVHADISINMSKHTTFFGAIRLGEAPAS

SEQ ID NO: 26585 - protein, 135 aa, Homo sapiens
  Payload ID: 5236
  Gene Symbol: EDA
  Gene Name: ectodysplasin A
  Uniprot ID: Q92838
  ENSP ID: ENSP00000434195
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQGHQ

SEQ ID NO: 26586 - protein, 148 aa, Homo sapiens
  Payload ID: 5236
  Gene Symbol: EDA
  Gene Name: ectodysplasin A
  Uniprot ID: Q92838
  ENSP ID: ENSP00000434861
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQDFDYIISFSYGLQGFC

SEQ ID NO: 26587 - protein, 259 aa, Homo sapiens
  Payload ID: 5236
  Gene Symbol: EDA
  Gene Name: ectodysplasin A
  ENSP ID: ENSP00000481963
MALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 26588 - protein, 448 aa, Homo sapiens
  Payload ID: 5237
  Gene Symbol: EDAR
  Gene Name: ectodysplasin A receptor
  Uniprot ID: Q9UNE0
  ENSP ID: ENSP00000258443
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATALIIAMSTIFIMAIAIVLIIMFYILKTKPSAPACCTSHPGKSVEAQVSKDEEKKEAPDNVVMFSEKDEFEKLTATPAKPTKSENDASSENEQLLSRSVDSDEEPAPDKQGSPELCLLSLVHLAREKSATSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS

SEQ ID NO: 26589 - protein, 480 aa, Homo sapiens
  Payload ID: 5237
  Gene Symbol: EDAR
  Gene Name: ectodysplasin A receptor
  Uniprot ID: Q9UNE0
  ENSP ID: ENSP00000365839
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATALIIAMSTIFIMAIAIVLIIMFYILKTKPSAPGDGPHAPVPCFLDSPSTPPVGEPGCSLPPLSPACCTSHPGKSVEAQVSKDEEKKEAPDNVVMFSEKDEFEKLTATPAKPTKSENDASSENEQLLSRSVDSDEEPAPDKQGSPELCLLSLVHLAREKSATSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS

SEQ ID NO: 26590 - protein, 480 aa, Homo sapiens; identical to SEQ ID NO: 26589
  Payload ID: 5237
  Gene Symbol: EDAR
  Gene Name: ectodysplasin A receptor
  Uniprot ID: Q9UNE0
  ENSP ID: ENSP00000386371

SEQ ID NO: 26591 - protein, 318 aa, Homo sapiens
  Payload ID: 5238
  Gene Symbol: EDA2R
  Gene Name: ectodysplasin A2 receptor
  Uniprot ID: Q9HAV5
  ENSP ID: ENSP00000253392
MDCQENEYWDQWGRCVTCQRCGPGQELSKDCGYGEGGDAYCTACPPRRYKSSWGHHRCQSCITCAVINRVQKVNCTATSNAVCGDCLPRFYRKTRIGGLQDQECIPCTKQTPTSEVQCAFQLSLVEADTPTVPPQEATLVALVSSLLVVFTLAFLGLFFLYCKQFFNRHCQREKLIIFSDPVPASLNLIPEFAGGLLQFEADKTAKEESLFPVPPSKETSAESQVSENIFQTQPLNPILEDDCSSTSGFPTQESFTMASCTSESHSHWVHSPIECTELDLQKFSSSASYTGAETLGGNTVESTGDRLELNVPFEVPSP

SEQ ID NO: 26592 - protein, 297 aa, Homo sapiens
  Payload ID: 5238
  Gene Symbol: EDA2R
  Gene Name: ectodysplasin A2 receptor
  Uniprot ID: Q9HAV5
  ENSP ID: ENSP00000363851
MDCQENEYWDQWGRCVTCQRCGPGQELSKDCGYGEGGDAYCTACPPRRYKSSWGHHRCQSCITCAVINRVQKVNCTATSNAVCGDCLPRFYRKTRIGGLQDQECIPCTKQTPTSEVQCAFQLSLVEADTPTVPPQEATLVALVSSLLVVFTLAFLGLFFLYCKQFFNRHCQRGGLLQFEADKTAKEESLFPVPPSKETSAESQVSENIFQTQPLNPILEDDCSSTSGFPTQESFTMASCTSESHSHWVHSPIECTELDLQKFSSSASYTGAETLGGNTVESTGDRLELNVPFEVPSP

SEQ ID NO: 26593 - protein, 318 aa, Homo sapiens; identical to SEQ ID NO: 26591
  Payload ID: 5238
  Gene Symbol: EDA2R
  Gene Name: ectodysplasin A2 receptor
  Uniprot ID: Q9HAV5
  ENSP ID: ENSP00000379365

SEQ ID NO: 26594 - protein, 297 aa, Homo sapiens; identical to SEQ ID NO: 26592
  Payload ID: 5238
  Gene Symbol: EDA2R
  Gene Name: ectodysplasin A2 receptor
  Uniprot ID: Q9HAV5
  ENSP ID: ENSP00000415242

SEQ ID NO: 26595 - protein, 643 aa, Homo sapiens
  Payload ID: 5239
  Gene Symbol: ENOX1
  Gene Name: ecto-NOX disulfide-thiol exchanger 1
  Uniprot ID: Q8TC92
  ENSP ID: ENSP00000261488
MVDAGGVENITQLPQELPQMMAAAADGLGSIAIDTTQLNMSVTDPTAWATAMNNLGMVPVGLPGQQLVSDSICVPGFDPSLNMMTGITPINPMIPGLGLVPPPPPTEVAVVKEIIHCKSCTLFPQNPNLPPPSTRERPPGCKTVFVGGLPENATEEIIQEVFEQCGDITAIRKSKKNFCHIRFAEEFMVDKAIYLSGYRMRLGSSTDKKDSGRLHVDFAQARDDFYEWECKQRMRAREERHRRKLEEDRLRPPSPPAIMHYSEHEAALLAEKLKDDSKFSEAITVLLSWIERGEVNRRSANQFYSMVQSANSHVRRLMNEKATHEQEMEEAKENFKNALTGILTQFEQIVAVFNASTRQKAWDHFSKAQRKNIDIWRKHSEELRNAQSEQLMGIRREEEMEMSDDENCDSPTKKMRVDESALAAQAYALKEENDSLRWQLDAYRNEVELLKQEKEQLFRTEENLTKDQQLQFLQQTMQGMQQQLLTIQEELNNKKSELEQAKEEQSHTQALLKVLQEQLKGTKELVETNGHSHEDSNEINVLTVALVNQDRENNIEKRSQGLKSEKEALLIGIISTFLHVHPFGANIEYLWSYMQQLDSKISANEIEMLLMRLPRMFKQEFTGVGATLEKRWKLCAFEGIKTT

SEQ ID NO: 26596 - protein, 643 aa, Homo sapiens; identical to SEQ ID NO: 26595
  Payload ID: 5239
  Gene Symbol: ENOX1
  Gene Name: ecto-NOX disulfide-thiol exchanger 1
  Uniprot ID: Q8TC92
  ENSP ID: ENSP00000415054

SEQ ID NO: 26597 - protein, 610 aa, Homo sapiens
  Payload ID: 5240
  Gene Symbol: ENOX2
  Gene Name: ecto-NOX disulfide-thiol exchanger 2
  Uniprot ID: Q16206
  ENSP ID: ENSP00000337146
MQRDFRWLWVYEIGYAADNSRTLNVDSTAMTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEESALVSQAEALKEENDSLRWQLDAYRNEVELLKQEQGKVHREDDPNKEQQLKLLQQALQGMQQHLLKVQEEYKKKEAELEKLKDDKLQVEKMLENLKEKESCASRLCASNQDSEYPLEKTMNSSPIKSEREALLVGIISTFLHVHPFGASIEYICSYLHRLDNKICTSDVECLMGRLQHTFKQEMTGVGASLEKRWKFCGFEGLKLT

SEQ ID NO: 26598 - protein, 610 aa, Homo sapiens; identical to SEQ ID NO: 26597
  Payload ID: 5240
  Gene Symbol: ENOX2
  Gene Name: ecto-NOX disulfide-thiol exchanger 2
  Uniprot ID: Q16206
  ENSP ID: ENSP00000359965

SEQ ID NO: 26599 - protein, 581 aa, Homo sapiens
  Payload ID: 5240
  Gene Symbol: ENOX2
  Gene Name: ecto-NOX disulfide-thiol exchanger 2
  Uniprot ID: Q16206
  ENSP ID: ENSP00000359973
MTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEESALVSQAEALKEENDSLRWQLDAYRNEVELLKQEQGKVHREDDPNKEQQLKLLQQALQGMQQHLLKVQEEYKKKEAELEKLKDDKLQVEKMLENLKEKESCASRLCASNQDSEYPLEKTMNSSPIKSEREALLVGIISTFLHVHPFGASIEYICSYLHRLDNKICTSDVECLMGRLQHTFKQEMTGVGASLEKRWKFCGFEGLKLT

SEQ ID NO: 26600 - protein, 581 aa, Homo sapiens; identical to SEQ ID NO: 26599
  Payload ID: 5240
  Gene Symbol: ENOX2
  Gene Name: ecto-NOX disulfide-thiol exchanger 2
  Uniprot ID: Q16206
  ENSP ID: ENSP00000377890

SEQ ID NO: 26601 - protein, 376 aa, Homo sapiens
  Payload ID: 5240
  Gene Symbol: ENOX2
  Gene Name: ecto-NOX disulfide-thiol exchanger 2
  ENSP ID: ENSP00000400304
MTLPMSDPTAWATAMNNLGMAPLGIAGQPILPDFDPALGMMTGIPPITPMMPGLGIVPPPIPPDMPVVKEIIHCKSCTLFPPNPNLPPPATRERPPGCKTVFVGGLPENGTEQIIVEVFEQCGEIIAIRKSKKNFCHIRFAEEYMVDKALYLSGYRIRLGSSTDKKDTGRLHVDFAQARDDLYEWECKQRMLAREERHRRRMEEERLRPPSPPPVVHYSDHECSIVAEKLKDDSKFSEAVQTLLTWIERGEVNRRSANNFYSMIQSANSHVRRLVNEKAAHEKDMEEAKEKFKQALSGILIQFEQIVAVYHSASKQKAWDHFTKAQRKNISVWCKQAEEIRNIHNDELMGIRREEEMEMSDDEIEEMTETKETEES

SEQ ID NO: 26602 - protein, 263 aa, Homo sapiens
  Payload ID: 5240
  Gene Symbol: ENOX2
  Gene Name: ecto-NOX disulfide-thiol exchanger 2
  ENSP ID: ENSP00000478608
MGPLHKSPAKNISVWCKQAEEIRNIHNDELMGIRREEEMEMSDDEIEEMTETKETEESALVSQAEALKEENDSLRWQLDAYRNEVELLKQEQGKVHREDDPNKEQQLKLLQQALQGMQQHLLKVQEEYKKKEAELEKLKDDKLQVEKMLENLKEKESCASRLCASNQDSEYPLEKTMNSSPIKSEREALLVGIISTFLHVHPFGASIEYICSYLHRLDNKICTSDVECLMGRLQHTFKQEMTGVGASLEKRWKFCGFEGLKLT

SEQ ID NO: 26603 - protein, 510 aa, Homo sapiens
  Payload ID: 5241
  Gene Symbol: ENTPD1
  Gene Name: ectonucleoside triphosphate diphosphohydrolase 1
  Uniprot ID: P49961
  ENSP ID: ENSP00000360248
MEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 26604 - protein, 522 aa, Homo sapiens
  Payload ID: 5241
  Gene Symbol: ENTPD1
  Gene Name: ectonucleoside triphosphate diphosphohydrolase 1
  Uniprot ID: P49961
  ENSP ID: ENSP00000360250
MGREELFLTFSFSSGFQESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 26605 - protein, 517 aa, Homo sapiens
  Payload ID: 5241
  Gene Symbol: ENTPD1
  Gene Name: ectonucleoside triphosphate diphosphohydrolase 1
  Uniprot ID: P49961
  ENSP ID: ENSP00000390955
MKGTKDLTSQQKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 26606 - protein, 402 aa, Homo sapiens
  Payload ID: 5241
  Gene Symbol: ENTPD1
  Gene Name: ectonucleoside triphosphate diphosphohydrolase 1
  Uniprot ID: P49961
  ENSP ID: ENSP00000442968
MERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 26607 - protein, 51 aa, Homo sapiens
  Payload ID: 5241
  Gene Symbol: ENTPD1
  Gene Name: ectonucleoside triphosphate diphosphohydrolase 1
  ENSP ID: ENSP00000489250
MEDTKESNVKTFCSKNILAILGFSSIIAVIALLAVGLTQNKALPENVKDGK

SEQ ID NO: 26608 - protein, 63 aa, Homo sapiens
  Payload ID: 5241
  Gene Symbol: ENTPD1
  Gene Name: ectonucleoside triphosphate diphosphohydrolase 1
  ENSP ID: ENSP00000489333
MERAREVIPRSQHQETPVYLGATAGMRLLRVPGSLLAKRKVPMAGLLSTICWANSVRKQGGSA

SEQ ID NO: 26609 - protein, 372 aa, Homo sapiens
  Payload ID: 5242
  Gene Symbol:
  Gene Name: Ectonucleoside triphosphate diphosphohydrolase 1 [Source:UniProtKB/Swiss-Prot Acc:P49961]
  Uniprot ID: P49961
  ENSP ID: ENSP00000440027
MESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 26610 - protein, 472 aa, Homo sapiens
  Payload ID: 5243
  Gene Symbol: ENTPD2
  Gene Name: ectonucleoside triphosphate diphosphohydrolase 2
  Uniprot ID: Q9Y5L3
  ENSP ID: ENSP00000312494
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 26611 - protein, 495 aa, Homo sapiens
  Payload ID: 5243
  Gene Symbol: ENTPD2
  Gene Name: ectonucleoside triphosphate diphosphohydrolase 2
  Uniprot ID: Q9Y5L3
  ENSP ID: ENSP00000347213
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQLQARVPGQRARLADYCAGAMFVQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 26612 - protein, 529 aa, Homo sapiens
  Payload ID: 5244
  Gene Symbol: ENTPD3
  Gene Name: ectonucleoside triphosphate diphosphohydrolase 3
  Uniprot ID: O75355
  ENSP ID: ENSP00000301825
MFTVLTRQPCEQAGLKALYRTPTIIALVVLLVSIVVLVSITVIQIHKQEVLPPGLKYGIVLDAGSSRTTVYVYQWPAEKENNTGVVSQTFKCSVKGSGISSYGNNPQDVPRAFEECMQKVKGQVPSHLHGSTPIHLGATAGMRLLRLQNETAANEVLESIQSYFKSQPFDFRGAQIISGQEEGVYGWITANYLMGNFLEKNLWHMWVHPHGVETTGALDLGGASTQISFVAGEKMDLNTSDIMQVSLYGYVYTLYTHSFQCYGRNEAEKKFLAMLLQNSPTKNHLTNPCYPRDYSISFTMGHVFDSLCTVDQRPESYNPNDVITFEGTGDPSLCKEKVASIFDFKACHDQETCSFDGVYQPKIKGPFVAFAGFYYTASALNLSGSFSLDTFNSSTWNFCSQNWSQLPLLLPKFDEVYARSYCFSANYIYHLFVNGYKFTEETWPQIHFEKEVGNSSIAWSLGYMLSLTNQIPAESPLIRLPIEPPVFVGTLAFFTAAALLCLAFLAYLCSATRRKRHSEHAFDHAVDSD

SEQ ID NO: 26613 - protein, 529 aa, Homo sapiens; identical to SEQ ID NO: 26612
  Payload ID: 5244
  Gene Symbol: ENTPD3
  Gene Name: ectonucleoside triphosphate diphosphohydrolase 3
  Uniprot ID: O75355
  ENSP ID: ENSP00000401565

SEQ ID NO: 26614 - protein, 452 aa, Homo sapiens
  Payload ID: 5244
  Gene Symbol: ENTPD3
  Gene Name: ectonucleoside triphosphate diphosphohydrolase 3
  Uniprot ID: O75355
  ENSP ID: ENSP00000404671
MFTVLTRQPCEQAGLKALYRTPTIIALVVLLVSIVVLVSITVIQIHKQEVLPPGLKYGIVLDAGSSRTTVYVYQWPAEKENNTGVVSQTFKCSVKGSGISSYGNNPQDVPRAFEECMQKVKGQVPSHLHGSTPIHLGATAGMRLLRLQNETAANEVLESIQSYFKSQPFDFRGAQIISGQEEGVYGWITANYLMGNFLEKNLWHMWVHPHGVETTGALDLGGASTQISFVAGEKMDLNTSDIMQVSLYGYVYTLYTHSFQCYGRNEAEKKFLAMLLQNSPTKNHLTNPCYPRDYSISFTMGHVFDSLCTVDQRPESYNPNDVITFEGTGDPSLCKEKVASIFDFKACHDQETCSFDGVYQPKIKGPFVAFAGFYYTASALNLSGSFSLDTFNSSTWNFCSQNWSQLPLLLPKFDEVYARSYCFSANYIYHLFVNGYKFTEETWPQIHFEKEE

SEQ ID NO: 26615 - protein, 130 aa, Homo sapiens
  Payload ID: 5244
  Gene Symbol: ENTPD3
  Gene Name: ectonucleoside triphosphate diphosphohydrolase 3
  ENSP ID: ENSP00000406555
MFTVLTRQPCEQAGLKALYRTPTIIALVVLLVSIVVLVSITVIQIHKQEVLPPGLKIGFHRVDQASLELLTSGDPPTSASQSGGIISMSHRAQPQLRYGIVLDAGSSRTTVYVYQWPAEKENNTGVVSQT

SEQ ID NO: 26616 - protein, 571 aa, Homo sapiens
  Payload ID: 5245
  Gene Symbol: ENTPD4
  Gene Name: ectonucleoside triphosphate diphosphohydrolase 4
  ENSP ID: ENSP00000348536
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRKIGMLIIPCSGGCPKLCCAVWQPPPYGATKHLQCAAWN

SEQ ID NO: 26617 - protein, 616 aa, Homo sapiens
  Payload ID: 5245
  Gene Symbol: ENTPD4
  Gene Name: ectonucleoside triphosphate diphosphohydrolase 4
  Uniprot ID: Q9Y227
  ENSP ID: ENSP00000351520
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTVSFASSQQEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRDIQQEAFRASHTHWRGVSFVYNHYLFSGCFLVVLLAILLYLLRLRRIHRRTPRSSSAAALWMEEGLPAQNAPGTL

SEQ ID NO: 26618 - protein, 608 aa, Homo sapiens
  Payload ID: 5245
  Gene Symbol: ENTPD4
  Gene Name: ectonucleoside triphosphate diphosphohydrolase 4
  Uniprot ID: Q9Y227
  ENSP ID: ENSP00000408573
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRDIQQEAFRASHTHWRGVSFVYNHYLFSGCFLVVLLAILLYLLRLRRIHRRTPRSSSAAALWMEEGLPAQNAPGTL

SEQ ID NO: 26619 - protein, 117 aa, Homo sapiens
  Payload ID: 5245
  Gene Symbol: ENTPD4
  Gene Name: ectonucleoside triphosphate diphosphohydrolase 4
  ENSP ID: ENSP00000427724
  MOD_RES (1)..(1): Any amino acid
XFVYCWPRHNGNPHDLLDIRQMRDKNRKPVVMKIKPEHVPRAKHKETPLYILCTAGMRILPESQQKAILEDLLTDIPVHFDFLFSDSHAEVISGKQEGVYAWIGINFVLGRFEHIED

SEQ ID NO: 26620 - protein, 127 aa, Homo sapiens
  Payload ID: 5245
  Gene Symbol: ENTPD4
  Gene Name: ectonucleoside triphosphate diphosphohydrolase 4
  ENSP ID: ENSP00000429455
MVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAA

SEQ ID NO: 26621 - protein, 214 aa, Homo sapiens
  Payload ID: 5245
  Gene Symbol: ENTPD4
  Gene Name: ectonucleoside triphosphate diphosphohydrolase 4
  ENSP ID: ENSP00000430579
TNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLSHRRPEPPPLLEKGAQRRRKRRGTTVESAVPARPLRIPETKKIGMLIIPCSGGCPKLCCAVWQPPPYGATKHLQCAAWN

SEQ ID NO: 26622 - protein, 428 aa, Homo sapiens
  Payload ID: 5246
  Gene Symbol: ENTPD5
  Gene Name: ectonucleoside triphosphate diphosphohydrolase 5
  Uniprot ID: O75356
  ENSP ID: ENSP00000335246
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLPQFEKTLEQTPRGYLTSFEMFNSTYKLYTHSYLGFGLKAARLATLGALETEGTDGHTFRSACLPRWLEAEWIFGGVKYQYGGNQEGEVGFEPCYAEVLRVVRGKLHQPEEVQRGSFYAFSYYYDRAVDTDMIDYEKGGILKVEDFERKAREVCDNLENFTSGSPFLCMDLSYITALLKDGFGFADSTVLQLTKKVNNIETGWALGATFHLLQSLGISH

SEQ ID NO: 26623 - protein, 91 aa, Homo sapiens
  Payload ID: 5246
  Gene Symbol: ENTPD5
  Gene Name: ectonucleoside triphosphate diphosphohydrolase 5
  ENSP ID: ENSP00000451483
MATSWGTVFFMLVVSCVCSAVSHRNQQTWFEGIFLSSMCPINVSASTLYGIMFDAGSTGTRIHVYTFVQKMPGHLWSLGKGGGVRCPPEKW

SEQ ID NO: 26624 - protein, 80 aa, Homo sapiens
  Payload ID: 5246
  Gene Symbol: ENTPD5
  Gene Name: ectonucleoside triphosphate diphosphohydrolase 5
  ENSP ID: ENSP00000451499
  MOD_RES (1)..(1): Any amino acid
XYAFSYYYDRAVDTDMIDYEKGGILKVEDFERKAREVCDNLENFTSGSPFLCMDLSYITALLKDGFGFADSTVLQAAVLR

SEQ ID NO: 26625 - protein, 211 aa, Homo sapiens
  Payload ID: 5246
  Gene Symbol: ENTPD5
  Gene Name: ectonucleoside triphosphate diphosphohydrolase 5
  ENSP ID: ENSP00000451591
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLP

SEQ ID NO: 26626 - protein, 407 aa, Homo sapiens
  Payload ID: 5246
  Gene Symbol: ENTPD5
  Gene Name: ectonucleoside triphosphate diphosphohydrolase 5
  ENSP ID: ENSP00000451810
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLPQFEKTLEQTPRGYLTSFEMFNSTYKLYTHSYLGFGLKAARLATLGALETEGTDGHTFRSACLPRWLEAEWIFGGVKYQYGGNQEGEVGFEPCYAEVLRVVRGKLHQPEEVQRGSFYAFSYYYDRAVDTDMIDYEKGGILKVEDFERKAREVCDNLENFTSGSPFLCMDLSYITALLKDGFGFADSTVLQHIISWVN

SEQ ID NO: 26627 - protein, 467 aa, Homo sapiens
  Payload ID: 5247
  Gene Symbol: ENTPD6
  Gene Name: ectonucleoside triphosphate diphosphohydrolase 6 (putative)
  Uniprot ID: O75354
  ENSP ID: ENSP00000347084
MQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 26628 - protein, 483 aa, Homo sapiens
  Payload ID: 5247
  Gene Symbol: ENTPD6
  Gene Name: ectonucleoside triphosphate diphosphohydrolase 6 (putative)
  Uniprot ID: O75354
  ENSP ID: ENSP00000353131
MKKGIRYETSRKTSYIFQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 26629 - protein, 484 aa, Homo sapiens
  Payload ID: 5247
  Gene Symbol: ENTPD6
  Gene Name: ectonucleoside triphosphate diphosphohydrolase 6 (putative)
  Uniprot ID: O75354
  ENSP ID: ENSP00000365840
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 26630 - protein, 295 aa, Homo sapiens
  Payload ID: 5247
  Gene Symbol: ENTPD6
  Gene Name: ectonucleoside triphosphate diphosphohydrolase 6 (putative)
  ENSP ID: ENSP00000365854
  MOD_RES (1)..(1): Any amino acid
XVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYGGSHLEREGTCLIPSVSDPGDTAAEQPLLMHGPHLRQPATPGVRLSQEQSAEAHSEN

SEQ ID NO: 26631 - protein, 313 aa, Homo sapiens
  Payload ID: 5247
  Gene Symbol: ENTPD6
  Gene Name: ectonucleoside triphosphate diphosphohydrolase 6 (putative)
  ENSP ID: ENSP00000390095
  MOD_RES (1)..(1): Any amino acid
XNRGVVSRGWRPGWRRPGRGSPKDRLPPAPRKRALVSVGVAERAVHETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGV

SEQ ID NO: 26632 - protein, 194 aa, Homo sapiens
  Payload ID: 5247
  Gene Symbol: ENTPD6
  Gene Name: ectonucleoside triphosphate diphosphohydrolase 6 (putative)
  ENSP ID: ENSP00000390511
MQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKVKKVFKASPFLVGDDCVSIMNGTDEGVSAWITINFLTGSLKTPGGSSVGMLDLGGGSTQI

SEQ ID NO: 26633 - protein, 300 aa, Homo sapiens
  Payload ID: 5247
  Gene Symbol: ENTPD6
  Gene Name: ectonucleoside triphosphate diphosphohydrolase 6 (putative)
  ENSP ID: ENSP00000390646
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKA

SEQ ID NO: 26634 - protein, 226 aa, Homo sapiens
  Payload ID: 5247
  Gene Symbol: ENTPD6
  Gene Name: ectonucleoside triphosphate diphosphohydrolase 6 (putative)
  ENSP ID: ENSP00000395064
MPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKVKKVFKASPFLVGDDCVSIMNGTDEGVSAWITINFLTGSLKTPGGSSVGMLDLGGGSTQIAFLPRVEGTLQASPPGYLTALRMFNRTYKLYSY

SEQ ID NO: 26635 - protein, 188 aa, Homo sapiens
  Payload ID: 5247
  Gene Symbol: ENTPD6
  Gene Name: ectonucleoside triphosphate diphosphohydrolase 6 (putative)
  ENSP ID: ENSP00000398844
MKKGIRYETSRKTSYIFQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLP

SEQ ID NO: 26636 - protein, 150 aa, Homo sapiens
  Payload ID: 5247
  Gene Symbol: ENTPD6
  Gene Name: ectonucleoside triphosphate diphosphohydrolase 6 (putative)
  ENSP ID: ENSP00000401573
  MOD_RES (1)..(1): Any amino acid
XPGRGSPKDRLPPAPRKRALVSVGVAERAVHETPTLTHETFKALKPGLSAYADDVEKVKKVFKASPFLVGDDCVSIMNGTDEGVSAWITINFLTGSLKTPGGSSVGMLDLGGGSTQIAFLPRVEGTLQASPPGYLTALRMFNRTYKLYSY

SEQ ID NO: 26637 - protein, 437 aa, Homo sapiens
  Payload ID: 5247
  Gene Symbol: ENTPD6
  Gene Name: ectonucleoside triphosphate diphosphohydrolase 6 (putative)
  ENSP ID: ENSP00000401895
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAASLHELCAARVSEVLQNRVHRTEEVKHVDFYAFSYYYDLAAGVGLIDAEKGGSLVVGDFEIAAKYGGSHLEREGTCLIPSVSDPGDTAAEQPLLMHGPHLRQPATPGVRLSQEQSAEAHSEN

SEQ ID NO: 26638 - protein, 311 aa, Homo sapiens
  Payload ID: 5247
  Gene Symbol: ENTPD6
  Gene Name: ectonucleoside triphosphate diphosphohydrolase 6 (putative)
  ENSP ID: ENSP00000406975
  MOD_RES (1)..(1): Any amino acid
XGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLK

SEQ ID NO: 26639 - protein, 296 aa, Homo sapiens
  Payload ID: 5247
  Gene Symbol: ENTPD6
  Gene Name: ectonucleoside triphosphate diphosphohydrolase 6 (putative)
  ENSP ID: ENSP00000408098
MPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQP

SEQ ID NO: 26640 - protein, 604 aa, Homo sapiens
  Payload ID: 5248
  Gene Symbol: ENTPD7
  Gene Name: ectonucleoside triphosphate diphosphohydrolase 7
  Uniprot ID: Q9NQZ7
  ENSP ID: ENSP00000359520
MARISFSYLCPASWYFTVPTVSPFLRQRVAFLGLFFISCLLLLMLIIDFRHWSASLPRDRQYERYLARVGELEATDTEDPNLNYGLVVDCGSSGSRIFVYFWPRHNGNPHDLLDIKQMRDRNSQPVVKKIKPGISAMADTPEHASDYLRPLLSFAAAHVPVKKHKETPLYILCTAGMRLLPERKQLAILADLVKDLPLEFDFLFSQSQAEVISGKQEGVYAWIGINFVLGRFDHEDESDAEATQELAAGRRRTVGILDMGGASLQIAYEVPTSTSVLPAKQEEAAKILLAEFNLGCDVQHTEHVYRVYVTTFLGFGGNFARQRYEDLVLNETLNKNRLLGQKTGLSPDNPFLDPCLPVGLTDVVERNSQVLHVRGRGDWVSCGAMLSPLLARSNTSQASLNGIYQSPIDFNNSEFYGFSEFFYCTEDVLRIGGRYHGPTFAKAAQDYCGMAWSVLTQRFKNGLFSSHADEHRLKYQCFKSAWMYQVLHEGFHFPYDYPNLRTAQLVYDREVQWTLGAILYKTRFLPLRDLRQEGVRQAHGSWFRLSFVYNHYLFFACILVVLLAIFLYLLRLRRIHHRQTRASAPLDLLWLEEVVPMMGVQVGP

SEQ ID NO: 26641 - protein, 70 aa, Homo sapiens
  Payload ID: 5248
  Gene Symbol: ENTPD7
  Gene Name: ectonucleoside triphosphate diphosphohydrolase 7
  ENSP ID: ENSP00000474132
  MOD_RES (1)..(1): Any amino acid
XCGAMLSPLLARSNTSQASLNGIYQSPIDFNNSEFYGFSEFFYCTEDVLRIGGRYHGPTFAKAAQLVAHK

SEQ ID NO: 26642 - protein, 458 aa, Homo sapiens
  Payload ID: 5249
  Gene Symbol: ENTPD8
  Gene Name: ectonucleoside triphosphate diphosphohydrolase 8
  Uniprot ID: Q5MY95
  ENSP ID: ENSP00000344089
MGLSRKEQVFLALLGASGVSGLTALILLLVEATSVLLPTDIKFGIVFDAGSSHTSLFLYQWLANKENGTGVVSQALACQVEGPGISSYTSNAAQAGESLQGCLEEALVLIPEAQHRKTPTFLGATAGMRLLSRKNSSQARDIFAAVTQVLGRSPVDFWGAELLAGQAEGAFGWITVNYGLGTLVKYSFTGEWIQPPEEMLVGALDMGGASTQITFVPGGPILDKSTQADFRLYGSDYSVYTHSYLCFGRDQMLSRLLVGLVQSRPAALLRHPCYLSGYQTTLALGPLYESPCVHATPPLSLPQNLTVEGTGNPGACVSAIRELFNFSSCQGQEDCAFDGVYQPPLRGQFYVEASYPGQDRWLRDYCASGLYILTLLHEGYGFSEETWPSLEFRKQAGGVDIGWTLGYMLNLTGMIPADAPAQWRAESYGVWVAKVVFMVLALVAVVGAALVQLFWLQD

SEQ ID NO: 26643 - protein, 495 aa, Homo sapiens
  Payload ID: 5249
  Gene Symbol: ENTPD8
  Gene Name: ectonucleoside triphosphate diphosphohydrolase 8
  Uniprot ID: Q5MY95
  ENSP ID: ENSP00000360561
MGLSRKEQVFLALLGASGVSGLTALILLLVEATSVLLPTDIKFGIVFDAGSSHTSLFLYQWLANKENGTGVVSQALACQVEGPGISSYTSNAAQAGESLQGCLEEALVLIPEAQHRKTPTFLGATAGMRLLSRKNSSQARDIFAAVTQVLGRSPVDFWGAELLAGQAEGAFGWITVNYGLGTLVKYSFTGEWIQPPEEMLVGALDMGGASTQITFVPGGPILDKSTQADFRLYGSDYSVYTHSYLCFGRDQMLSRLLVGLVQSRPAALLRHPCYLSGYQTTLALGPLYESPCVHATPPLSLPQNLTVEGTGNPGACVSAIRELFNFSSCQGQEDCAFDGVYQPPLRGQFYAFSNFYYTFHFLNLTSRQPLSTVNATIWEFCQRPWKLVEASYPGQDRWLRDYCASGLYILTLLHEGYGFSEETWPSLEFRKQAGGVDIGWTLGYMLNLTGMIPADAPAQWRAESYGVWVAKVVFMVLALVAVVGAALVQLFWLQD

SEQ ID NO: 26644 - protein, 222 aa, Homo sapiens
  Payload ID: 5249
  Gene Symbol: ENTPD8
  Gene Name: ectonucleoside triphosphate diphosphohydrolase 8
  ENSP ID: ENSP00000420099
LGASGVSGLTALILLLVEATSVLLPTDIKFGIVFDAGSSHTSLFLYQWLANKENGTGVVSQALACQVEGPGISSYTSNAAQAGESLQGCLEEALVLIPEAQHRKTPTFLGATAGMRLLSSHPGPGPVSRGLLGCRAPGRAGRRCLWLDHCQLRLGDAGQVLLHWRMDPASGGDAGGCPGHGRGLHPDHVRAWGPHLGQEHPGRFSPLRLRLQRLHSQLPVLW

SEQ ID NO: 26645 - protein, 495 aa, Homo sapiens; identical to SEQ ID NO: 26643
  Payload ID: 5249
  Gene Symbol: ENTPD8
  Gene Name: ectonucleoside triphosphate diphosphohydrolase 8
  Uniprot ID: Q5MY95
  ENSP ID: ENSP00000420531

SEQ ID NO: 26646 - protein, 925 aa, Homo sapiens
  Payload ID: 5250
  Gene Symbol: ENPP1
  Gene Name: ectonucleotide pyrophosphatase/phosphodiesterase 1
  Uniprot ID: P22413
  ENSP ID: ENSP00000354238
MERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERPHFYTLYLEEPDSSGHSYGPVSSEVIKALQRVDGMVGMLMDGLKELNLHRCLNLILISDHGMEQGSCKKYIYLNKYLGDVKNIKVIYGPAARLRPSDVPDKYYSFNYEGIARNLSCREPNQHFKPYLKHFLPKRLHFAKSDRIEPLTFYLDPQWQLALNPSERKYCGSGFHGSDNVFSNMQALFVGYGPGFKHGIEADTFENIEVYNLMCDLLNLTPAPNNGTHGSLNHLLKNPVYTPKHPKEVHPLVQCPFTRNPRDNLGCSCNPSILPIEDFQTQFNLTVAEEKIIKHETLPYGRPRVLQKENTICLLSQHQFMSGYSQDILMPLWTSYTVDRNDSFSTEDFSNCLYQDFRIPLSPVHKCSFYKNNTKVSYGFLSPPQLNKNSSGIYSEALLTTNIVPMYQSFQVIWRYFHDTLLRKYAEERNGVNVVSGPVFDFDYDGRCDSLENLRQKRRVIRNQEILIPTHFFIVLTSCKDTSQTPLHCENLDTLAFILPHRTDNSESCVHGKHDSSWVEELLMLHRARITDVEHITGLSFYQQRKEPVSDILKLKTHLPTFSQED

SEQ ID NO: 26647 - protein, 378 aa, Homo sapiens
  Payload ID: 5250
  Gene Symbol: ENPP1
  Gene Name: ectonucleotide pyrophosphatase/phosphodiesterase 1
  ENSP ID: ENSP00000422424
MERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERRTRFFRSFIWTSQQ

SEQ ID NO: 26648 - protein, 863 aa, Homo sapiens
  Payload ID: 5251
  Gene Symbol: ENPP2
  Gene Name: ectonucleotide pyrophosphatase/phosphodiesterase 2
  Uniprot ID: Q13822
  ENSP ID: ENSP00000075322
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 26649 - protein, 915 aa, Homo sapiens
  Payload ID: 5251
  Gene Symbol: ENPP2
  Gene Name: ectonucleotide pyrophosphatase/phosphodiesterase 2
  Uniprot ID: Q13822
  ENSP ID: ENSP00000259486
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEESSYGSPFTPAKRPKRKVAPKRRQERPVAPPKKRRRKIHRMDHYAAETRQDKMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 26650 - protein, 884 aa, Homo sapiens
  Payload ID: 5251
  Gene Symbol: ENPP2
  Gene Name: ectonucleotide pyrophosphatase/phosphodiesterase 2
  ENSP ID: ENSP00000403315
MTRHADRIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEAETRKFRGSRNENKENINGNFEPRKERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 26651 - protein, 888 aa, Homo sapiens
  Payload ID: 5251
  Gene Symbol: ENPP2
  Gene Name: ectonucleotide pyrophosphatase/phosphodiesterase 2
  Uniprot ID: Q13822
  ENSP ID: ENSP00000428291
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEAETRKFRGSRNENKENINGNFEPRKERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 26652 - protein, 245 aa, Homo sapiens
  Payload ID: 5251
  Gene Symbol: ENPP2
  Gene Name: ectonucleotide pyrophosphatase/phosphodiesterase 2
  ENSP ID: ENSP00000428304
MARRSSFQSCQIISLFTFAVGVNICLGFTAHRIKRAEGWEEGPPTVLSDSPWTNISGSCKGRCFELQEAGPPDCRCDNLSRGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPVSFA

SEQ ID NO: 26653 - protein, 162 aa, Homo sapiens
  Payload ID: 5251
  Gene Symbol: ENPP2
  Gene Name: ectonucleotide pyrophosphatase/phosphodiesterase 2
  ENSP ID: ENSP00000429447
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGGP

SEQ ID NO: 26654 - protein, 498 aa, Homo sapiens
  Payload ID: 5251
  Gene Symbol: ENPP2
  Gene Name: ectonucleotide pyrophosphatase/phosphodiesterase 2
  ENSP ID: ENSP00000429476
MEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 26655 - protein, 875 aa, Homo sapiens [sequence omitted]

SEQ ID NO: 26656 - protein, 663 aa, Homo sapiens
  Payload ID: 5252
  Gene Symbol: ENPP3
  Gene Name: ectonucleotide pyrophosphatase/phosphodiesterase 3
  ENSP ID: ENSP00000350964
MESTLTLATEQPVKKNTLKKYKIACIVLLALLVIMSLGLGLGLGLRKLEKQGSCRKKCFDASFRGLENCRCDVACKDRGDCCWDFEDTCVESTRIWMCNKFRCGETRLEASLCSCSDDCLQRKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPMWLTAMYQGLKAATYFWPGSEVAINGSFPSIYMPYNGSVPFEERISTLLKWLDLPKAERPRFYTMYFEEPDSSGHAGGPVSARVIKALQVVDHAFGMLMEGLKQRNLHNCVNIILLADHGMDQTYCNKMEYMTDYFPRINFFYMYEGPAPRIRAHNIPHDFFSFNSEEIVRNLSCRKPDQHFKPYLTPDLPKRLHYAKNVRIDKVHLFVDQQWLAVRSKSNTNCGGGNHGYNNEFRSMEAIFLAHGPSFKEKTEVEPFENIEVYNLMCDLLRIQPAPNNGTHGSLNHLLKVPFYEPSHAEEVSKFSVCGFANPLPTESLDCFCPHLQNSTQLEQVNQMLNLTQEEITATVKVNLPFGRPRVLQKNVDHCLLYHREYVSGFGKAMRMPMWSSYTVPQLPAIEHQIANMML

SEQ ID NO: 26657 - protein, 875 aa, Homo sapiens [sequence omitted]

SEQ ID NO: 26658 - protein, 53 aa, Homo sapiens
  Payload ID: 5252
  Gene Symbol: ENPP3
  Gene Name: ectonucleotide pyrophosphatase/phosphodiesterase 3
  ENSP ID: ENSP00000408642
MESTLTLATEQPVKKNTLKKYKIACITGSLSFGISPHHNLCFPGSSDPPASAS

SEQ ID NO: 26659 - protein, 53 aa, Homo sapiens
  Payload ID: 5252
  Gene Symbol: ENPP3
  Gene Name: ectonucleotide pyrophosphatase/phosphodiesterase 3
  ENSP ID: ENSP00000415589
MESTLTLATEQPVKKNTLKKYKIACIGLSPLGSHLTTTSVSQAQVILLPQPPE

SEQ ID NO: 26660 - protein, 453 aa, Homo sapiens
  Payload ID: 5253
  Gene Symbol: ENPP4
  Gene Name: ectonucleotide pyrophosphatase/phosphodiesterase 4 (putative)
  Uniprot ID: Q9Y6X5
  ENSP ID: ENSP00000318066
MKLLVILLFSGLITGFRSDSSSSLPPKLLLVSFDGFRADYLKNYEFPHLQNFIKEGVLVEHVKNVFITKTFPNHYSIVTGLYEESHGIVANSMYDAVTKKHFSDSNDKDPFWWNEAVPIWVTNQLQENRSSAAAMWPGTDVPIHDTISSYFMNYNSSVSFEERLNNITMWLNNSNPPVTFATLYWEEPDASGHKYGPEDKENMSRVLKKIDDLIGDLVQRLKMLGLWENLNVIITSDHGMTQCSQDRLINLDSCIDHSYYTLIDLSPVAAILPKINRTEVYNKLKNCSPHMNVYLKEDIPNRFYYQHNDRIQPIILVADEGWTIVLNESSQKLGDHGYDNSLPSMHPFLAAHGPAFHKGYKHSTINIVDIYPMMCHILGLKPHPNNGTFGHTKCLLVDQWCINLPEAIAIVIGSLLVLTMLTCLIIIMQNRLSVPRPFSRLQLQEDDDDPLIG

SEQ ID NO: 26661 - protein, 477 aa, Homo sapiens
  Payload ID: 5254
  Gene Symbol: ENPP5
  Gene Name: ectonucleotide pyrophosphatase/phosphodiesterase 5 (putative)
  Uniprot ID: Q9UJA9
  ENSP ID: ENSP00000230565
MTSKFLLVSFILAALSLSTTFSLQPDQQKVLLVSFDGFRWDYLYKVPTPHFHYIMKYGVHVKQVTNVFITKTYPNHYTLVTGLFAENHGIVANDMFDPIRNKSFSLDHMNIYDSKFWEEATPIWITNQRAGHTSGAAMWPGTDVKIHKRFPTHYMPYNESVSFEDRVAKIIEWFTSKEPINLGLLYWEDPDDMGHHLGPDSPLMGPVISDIDKKLGYLIQMLKKAKLWNTLNLIITSDHGMTQCSEERLIELDQYLDKDHYTLIDQSPVAAILPKEGKFDEVYEALTHAHPNLTVYKKEDVPERWHYKYNSRIQPIIAVADEGWHILQNKSDDFLLGNHGYDNALADMHPIFLAHGPAFRKNFSKEAMNSTDLYPLLCHLLNITAMPHNGSFWNVQDLLNSAMPRVVPYTQSTILLPGSVKPAEYDQEGSYPYFIGVSLGSIIVIVFFVIFIKHLIHSQIPALQDMHAEIAQPLLQA

SEQ ID NO: 26662 - protein, 477 aa, Homo sapiens; identical to SEQ ID NO: 26661
  Payload ID: 5254
  Gene Symbol: ENPP5
  Gene Name: ectonucleotide pyrophosphatase/phosphodiesterase 5 (putative)
  Uniprot ID: Q9UJA9
  ENSP ID: ENSP00000360436

SEQ ID NO: 26663 - protein, 440 aa, Homo sapiens
  Payload ID: 5255
  Gene Symbol: ENPP6
  Gene Name: ectonucleotide pyrophosphatase/phosphodiesterase 6
  Uniprot ID: Q6UWR7
  ENSP ID: ENSP00000296741
MAVKLGTLLLALALGLAQPASARRKLLVFLLDGFRSDYISDEALESLPGFKEIVSRGVKVDYLTPDFPSLSYPNYYTLMTGRHCEVHQMIGNYMWDPTTNKSFDIGVNKDSLMPLWWNGSEPLWVTLTKAKRKVYMYYWPGCEVEILGVRPTYCLEYKNVPTDINFANAVSDALDSFKSGRADLAAIYHERIDVEGHHYGPASPQRKDALKAVDTVLKYMTKWIQERGLQDRLNVIIFSDHGMTDIFWMDKVIELNKYISLNDLQQVKDRGPVVSLWPAPGKHSEIYNKLSTVEHMTVYEKEAIPSRFYYKKGKFVSPLTLVADEGWFITENREMLPFWMNSTGRREGWQRGWHGYDNELMDMRGIFLAFGPDFKSNFRAAPIRSVDVYNVMCNVVGITPLPNNGSWSRVMCMLKGRASTAPPVWPSHCALALILLFLLA

SEQ ID NO: 26664 - protein, 194 aa, Homo sapiens
  Payload ID: 5255
  Gene Symbol: ENPP6
  Gene Name: ectonucleotide pyrophosphatase/phosphodiesterase 6
  ENSP ID: ENSP00000423497
MIGNYMWDPTTNKSFDIGVNKDSLMPLWWNGSEPLWVTLTKAKRKVYMYYWPGCEVEILGVRPTYCLEYKNVPTDINFANAVSDALDSFKSGRADLAAIYHERIDVEGHHYGPASPQRKDALKAVDTVLKYMTKWIQERGLQDRLNVIIFSDHGMTDIFWMDKVIELNKYISLNDLQQVKDRGPVVSLWPAPGK

SEQ ID NO: 26665 - protein, 458 aa, Homo sapiens
  Payload ID: 5256
  Gene Symbol: ENPP7
  Gene Name: ectonucleotide pyrophosphatase/phosphodiesterase 7
  Uniprot ID: Q6UWV6
  ENSP ID: ENSP00000332656
MRGPAVLLTVALATLLAPGAGAPVQSQGSQNKLLLVSFDGFRWNYDQDVDTPNLDAMARDGVKARYMTPAFVTMTSPCHFTLVTGKYIENHGVVHNMYYNTTSKVKLPYHATLGIQRWWDNGSVPIWITAQRQGLRAGSFFYPGGNVTYQGVAVTRSRKEGIAHNYKNETEWRANIDTVMAWFTEEDLDLVTLYFGEPDSTGHRYGPESPERREMVRQVDRTVGYLRESIARNHLTDRLNLIITSDHGMTTVDKRAGDLVEFHKFPNFTFRDIEFELLDYGPNGMLLPKEGRLEKVYDALKDAHPKLHVYKKEAFPEAFHYANNPRVTPLLMYSDLGYVIHGRINVQFNNGEHGFDNKDMDMKTIFRAVGPSFRAGLEVEPFESVHVYELMCRLLGIVPEANDGHLATLLPMLHTESALPPDGRPTLLPKGRSALPPSSRPLLVMGLLGTVILLSEVA

SEQ ID NO: 26666 - protein, 159 aa, Homo sapiens
  Payload ID: 5256
  Gene Symbol: ENPP7
  Gene Name: ectonucleotide pyrophosphatase/phosphodiesterase 7
  ENSP ID: ENSP00000460429
LKDAHPKLHVYKKEAFPEAFHYANNPRVTPLLMYSDLGYVIHGRINVQFNNGEHGFDNKDMDMKTIFRAVGPSFRAGLEVEPFESVHVYELMCRLLGIVPEANDGHLATLLPMLHTESALPPDGRPTLLPKGRSALPPSSRPLLVMGLLGTVILLSEVA

SEQ ID NO: 26667 - protein, 2579 aa, Homo sapiens
  Payload ID: 5257
  Gene Symbol: EPG5
  Gene Name: ectopic P-granules autophagy protein 5 homolog (C. elegans)
  Uniprot ID: Q9HCE0
  ENSP ID: ENSP00000282041
MAEAVKPQRRAKAKASRTKTKEKKKYETPQREESSEVSLPKTSREQEIPSLACEFKGDHLKVVTDSQLQDDASGQNESEMFDVPLTSLTISNEESLTCNTEPPKEGGEARPCVGDSAVTPKVHPGDNVGTKVETPKNFTEVEENMSVQGGLSESAPQSNFSYTQPAMENIQVRETQNSKEDKQGLVCSSEVPQNVGLQSSCPAKHGFQTPRVKKLYPQLPAEIAGEAPALVAVKPLLRSERLYPELPSQLELVPFTKEQLKILEPGSWLENVESYLEEFDSMAHQDRHEFYELLLNYSRCRKQLLLAEAELLTLTSDCQNAKSRLWQFKEEQMSVQGICADQVKVFSYHRYQRVEMNENALVELKKLFDAKSEHLHQTLALHSYTSVLSRLQVESYIYALLSSSAVLRSSAIHQQGRASKQTESIPSDLCQLKECISVLFMFTRRVNEDTQFHDDILLWLQKLVSVLQRVGCPGDHLFLLNHILRCPAGVSKWAVPFIQIKVLHNPSGVFHFMQSLALLMSPVKNRAEFMCHMKPSERKPSSSGPGSGTWTLVDEGGEEDEDPETSWILLNEDDLVTILAQFPFHELFQHLLGFKAKGDYLPETTRPQEMMKIFAFANSLVELLAVGLETFNRARYRQFVKRIGYMIRMTLGYVSDHWAQYVSHNQGSGLAQQPYSMEKLQVEFDELFLRAVLHVLKAKRLGIWLFMSEMPFGTLSVQMLWKLFYLMHQVESENLQQLSSSLQPAQCKQQLQDPEHFTNFEKCLSSMNSSEEICLLTTFAQMAQARRTNVDEDFIKIIVLEIYEVSYVTLSTRETFSKVGRELLGTITAVHPEIISVLLDRVQETIDQVGMVSLYLFKELPLYLWQPSASEIAVIRDWLLNYNLTVVKNKLACVILEGLNWGFAKQATLHLDQAVHAEVALMVLEAYQKYLAQKPYAGILSESMKQVSYLASIVRYGETPETSFNQWAWNLILRLKLHKNDYGIQPNCPAVPFSVTVPDMTESPTFHPLLKAVKAGMPIGCYLALSMTAVGHSIEKFCAEGIPLLGILVQSRHLRTVVHVLDKILPLFYPCQYYLLKNEQFLSHLLLFLHLDSGVPQGVTQQVTHKVAQHLTGASHGDNVKLLNSMIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQDLWMEYLNMERIYHEFQETVGLWTQAKLESHSTPCSLSVQLDFTDPLLAKERVLSNLRKHEAPQPPLALHPTKPPVPVISSAVLLSQKDATQLVCTDLNLLQQQARTAALRESQQVALDGELLDTMPKQYVNREEQTTLHLECRGSSGKKCQGAAVVTVQFEGMHKNEAISQQLHVLRKEVKQLQAEAAKPPSLNIVEAAVHAENLITALVNAYKLQPTPGIQKVGISLFFTIVDYVSDETQRHPPTRQFFTSCIEILGQVFISGIKSECRKVLETILKNSRLCSLLSPFFTPNAAPAEFIQLYEQVVKFLSEDNSDMIFMLLTKFDLKQWLSATKPPLSDRTRLLESIHLALTAWGLEPDEDILMPFNLFCKHWTYLLLYQFPDQYSDILRLLMQSSAEQLLSPECWKATLRALGCCAPSCQQGAASTEGAVLPSSSDALLSDKQVMETIQWLSDFFYKLRLSKMDFKSFGLFSKWSPYMADVKTFLGYLVKRLIDLEMTCLAQDPTASRKTVLKSLHSVIIQLFKPWILVLEDNESSQQRHYPWLESDTVVASSIVQLFTDCIDSLHESFKDKLLPGDAGALWLHLMHYCEACTAPKMPEFILYAFHSTYRKLPWKDLHPDQMLMEAFFKVERGSPKSCFLFLGSVLCEVNWVSVLSDAWNSSPHPETRSMIVCLLFMMILLAKEVQLVDQTDSPLLSLLGQTSSLSWHLVDIVSYQSVLSYFSSHYPPSIILAKESYAELIMKLLKVSAGLSIPTDSQKHLDAVPKCQAFTHQMVQFLSTLEQNGKITLAVLEQEMSKLLDDIIVFNPPDMDSQTRHMALSSLFMEVLMMMNNATIPTAEFLRGSIRTWIGQKMHGLVVLPLLTAACQSLASVRHMAETTEACITAYFKESPLNQNSGWGPILVSLQVPELTMEEFLQECLTLGSYLTLYVYLLQCLNSEQTLRNEMKVLLILSKWLEQVYPSSVEEEAKLFLWWHQVLQLSLIQTEQNDSVLTESVIRILLLVQSRQNLVAEERLSSGILGAIGFGRKSPLSNRFRVVARSMAAFLSVQVPMEDQIRLRPGSELHLTPKAQQALNALESMASSKQYVEYQDQILQATQFIRHPGHCLQDGKSFLALLVNCLYPEVHYLDHIR

SEQ ID NO: 26668 - protein, 657 aa, Homo sapiens
  Payload ID: 5257
  Gene Symbol: EPG5
  Gene Name: ectopic P-granules autophagy protein 5 homolog (C. elegans)
  ENSP ID: ENSP00000466403
MIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQDLWMEYLNMERIYHEFQETVGLWTQAKLESHSTPCSLSVQLDFTDPLLAKERVLSNLRKHEAPQPPLALHPTKPPVPVISSAVLLSQKDATQLVCTDLNLLQQQARTAALRESQQVALDGELLDTMPKQYVNREEQTTLHLECRGSSGKKCQGAAVVTVQFEGMHKNEAISQQLHVLRKEVKQLQAEAAKPPSLNIVEAAVHAENLITALVNAYKLQPTPGIQKVGISLFFTIVDYVSDETQRHPPTRQFFTSCIEILGQVFISGIKSECRKVLETILKNSRLCSLLSPFFTPNAAPAEFIQLYEQVVKFLSEDNSDMIFMLLTKASGVHSLGTYCLGP

SEQ ID NO: 26669 - protein, 336 aa, Homo sapiens
  Payload ID: 5257
  Gene Symbol: EPG5
  Gene Name: ectopic P-granules autophagy protein 5 homolog (C. elegans)
  ENSP ID: ENSP00000466990
MIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQGCSLLSIDPSTRMGFRKL

SEQ ID NO: 26670 - protein, 505 aa, Homo sapiens
  Payload ID: 5257
  Gene Symbol: EPG5
  Gene Name: ectopic P-granules autophagy protein 5 homolog (C. elegans)
  ENSP ID: ENSP00000467066
  MOD_RES (1)..(1): Any amino acid
XVERGSPKSCFLFLGSVLCEVNWVSVLSDAWNSSPHPETRSMIVCLLFMMILLAKEVQLVDQTDSPLLSLLGQTSSLSWHLVDIVSYQSVLSYFSSHYPPSIILAKESYAELIMKLLKVSAGLSIPTDSQKHLDAVPKCQAFTHQMVQFLSTLEQNGKITLAVLEQEMSKLLDDIIVFNPPDMDSQTRHMALSSLFMEVLMMMNNATIPTAEFLRGSIRTWIGQKMHGLVVLPLLTAACQSLASVRHMAETTEACITAYFKESPLNQNSGWGPILVSLQVPELTMEEFLQECLTLGSYLTLYVYLLQCLNSEQTLRNEMKVLLILSKWLEQVYPSSVEEEAKLFLWWHQVLQLSLIQTEQNDSVLTESVIRILLLVQSRQNLVAEERLSSGILGAIGFGRKSPLSNRFRVVARSMAAFLSVQVPMEDQIRLRPGSELHLTPKAQQALNALESMASSKQYVEYQDQILQATQFIRHPGHCLQDGKSFLALLVNCLYPEVHYLDHIR

SEQ ID NO: 26671 - protein, 856 aa, Homo sapiens
  Payload ID: 5257
  Gene Symbol: EPG5
  Gene Name: ectopic P-granules autophagy protein 5 homolog (C. elegans)
  ENSP ID: ENSP00000467464
MIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQDLWMEYLNMERIYHEFQETVGLWTQAKLESHSTPCSLSVQLDFTDPLLAKERVLSNLRKHEAPQPPLALHPTKPPVPVISSAVLLSQKDATQLVCTDLNLLQQQARTAALRESQQVALDGELLDTMPKQYVNREEQTTLHLECRGSSGKKCQGAAVVTVQFEGMHKNEAISQQLHVLRKEVKQLQAEAAKPPSLNIVEAAVHAENLITALVNAYKLQPTPGIQKVGISLFFTIVDYVSDETQRHPPTRQFFTSCIEILGQVFISGIKSECRKVLETILKNSRLCSLLSPFFTPNAAPAEFIQLYEQVVKFLSEDNSDMIFMLLTKFDLKQWLSATKPPLSDRTRLLESIHLALTAWGLEPDEDILMPFNLFCKHWTYLLLYQFPDQYSDILRLLMQSSAEQLLSPECWKATLRALGCCAPSCQQGAASTEGAVLPSSSDALLSDKQVMETIQWLSDFFYKLRLSKMDFKSFGLFSKWSPYMADVKTFLGYLVKRLIDLEMTCLAQDPTASRKTVLKSLHSVIIQLFKPWILVLEDNER

SEQ ID NO: 26672 - protein, 215 aa, Homo sapiens
  Payload ID: 5258
  Gene Symbol: EDARADD
  Gene Name: EDAR-associated death domain
  Uniprot ID: Q8WWZ3
  ENSP ID: ENSP00000335076
MGLRTTKQMGRGTKAPGHQEDHMVKEPVEDTDPSTLSFNMSDKYPIQDTELPKAEECDTITLNCPRNSDMKNQGEENGFPDSTGDPLPEISKDNSCKENCTCSSCLLRAPTISDLLNDQDLLDVIRIKLDPCHPTVKNWRNFASKWGMSYDELCFLEQRPQSPTLEFLLRNSQRTVGQLMELCRLYHRADVEKVLRRWVDEEWPKRERGDPSRHF

SEQ ID NO: 26673 - protein, 205 aa, Homo sapiens
  Payload ID: 5258
  Gene Symbol: EDARADD
  Gene Name: EDAR-associated death domain
  Uniprot ID: Q8WWZ3
  ENSP ID: ENSP00000352320
MASPDDPLRADHMVKEPVEDTDPSTLSFNMSDKYPIQDTELPKAEECDTITLNCPRNSDMKNQGEENGFPDSTGDPLPEISKDNSCKENCTCSSCLLRAPTISDLLNDQDLLDVIRIKLDPCHPTVKNWRNFASKWGMSYDELCFLEQRPQSPTLEFLLRNSQRTVGQLMELCRLYHRADVEKVLRRWVDEEWPKRERGDPSRHF

SEQ ID NO: 26674 - protein, 84 aa, Homo sapiens
  Payload ID: 5258
  Gene Symbol: EDARADD
  Gene Name: EDAR-associated death domain
  ENSP ID: ENSP00000405815
MVKEPVEDTDPSTLSFNMSDKYPIQDTELPKAEECDTITLNCPRNSDMKNQGEENGFPDSTGDPLPEISKDNSCKENCTCSSCL

SEQ ID NO: 26675 - protein, 151 aa, Homo sapiens
  Payload ID: 5259
  Gene Symbol: EEF1E1-BLOC1S5
  Gene Name: EEF1E1-BLOC1S5 readthrough (NMD candidate)
  ENSP ID: ENSP00000380597
MAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIILEKFIQGFWITDQLFKVKLVIL

SEQ ID NO: 26676 - protein, 598 aa, Homo sapiens
  Payload ID: 5260
  Gene Symbol: EFCC1
  Gene Name: EF-hand and coiled-coil domain containing 1
  Uniprot ID: Q9HA90
  ENSP ID: ENSP00000414597
MEPVSTGAEAGMEGAGGDPYRRPARRTQWLLSALAHHYGLDRGVENEIVVLATGLDQYLQEVFHHLDCRGAGRLPRADFRALCAVLGLRAEGATTAGQAAGDGNSRDVTPGDAAAELATDGDSDTDEEARLALRAEPPELTFRQFHARLCGYFGTRAGPRLPRGALSEHIETQIRLRRPRRRRRPPCAPGPDSGPDCERVARLEEENSSLRELVEDLRAALQSSDARCLALQVGLWKSQASTHEMGHGGPEAAVRELRQAQGALAAAEARAGRLRRGQAEVRRRAEEARQVVLRSLHRVRELEALAQQVPGLQRWVRRLEAELQRYRSEDSQLPTPQLANPEPGDKSNEPEDAGTRDPDPTPEGAWQSDSSSGSRALDEVDEQLFRSVEGQAASDEEEVEEERWQEEKKTPAAEAKTLLARLSSCRGRCDDQTAEKLMTYFGHFGGANHAHTLGELEACIAMLVEQLRTQGCGGRTLGTSEEEAELQQKVEENEHLRLELQMVETERVRLSLLEEKLVDVLQLLQRLRDLNISKRALGKILLSTLDAFRDPTHEGRPSPAAILDALHQALAACQLLRRQPSAPASAAAALTNPLLVSC

SEQ ID NO: 26677 - protein, 211 aa, Homo sapiens
  Payload ID: 5261
  Gene Symbol: EFCAB1
  Gene Name: EF-hand calcium binding domain 1
  Uniprot ID: Q9HAE3
  ENSP ID: ENSP00000262103
MNRKKLQKLTDTLTKNCKHFNKFEVNCLIKLFYDLVGGVERQGLVVGLDRNAFRNILHVTFGMTDDMIMDRVFRGFDKDNDGCVNVLEWIHGLSLFLRGSLEEKMKYCFEVFDLNGDGFISKEEMFHMLKNSLLKQPSEEDPDEGIKDLVEITLKKMDHDHDGKLSFADYELAVREETLLLEAFGPCLPDPKSQMEFEAQVFKDPNEFNDM

SEQ ID NO: 26678 - protein, 159 aa, Homo sapiens
  Payload ID: 5261
  Gene Symbol: EFCAB1
  Gene Name: EF-hand calcium binding domain 1
  Uniprot ID: Q9HAE3
  ENSP ID: ENSP00000400873
MNRKKLQKLTDTLTKNCKHLFRGFDKDNDGCVNVLEWIHGLSLFLRGSLEEKMKYCFEVFDLNGDGFISKEEMFHMLKNSLLKQPSEEDPDEGIKDLVEITLKKMDHDHDGKLSFADYELAVREETLLLEAFGPCLPDPKSQMEFEAQVFKDPNEFNDM

SEQ ID NO: 26679 - protein, 78 aa, Homo sapiens
  Payload ID: 5261
  Gene Symbol: EFCAB1
  Gene Name: EF-hand calcium binding domain 1
  ENSP ID: ENSP00000429644
  MOD_RES (1)..(1): Any amino acid
XKQPSEEDPDEGIKDLVEITLKKMDHDHDGKLSFADYELAVREETLLLEAFGPCLPDPKSQMEFEAQVFKDPNEFNDM

SEQ ID NO: 26680 - protein, 54 aa, Homo sapiens
  Payload ID: 5261
  Gene Symbol: EFCAB1
  Gene Name: EF-hand calcium binding domain 1
  ENSP ID: ENSP00000430374
MNRKKLQKLTDTLTKNCKHLFRGFDKDNDGCVNVLEWIHGLSLFLRGSLEEKMK

SEQ ID NO: 26681 - protein, 159 aa, Homo sapiens; identical to SEQ ID NO: 26678
  Payload ID: 5261
  Gene Symbol: EFCAB1
  Gene Name: EF-hand calcium binding domain 1
  Uniprot ID: Q9HAE3
  ENSP ID: ENSP00000430765

SEQ ID NO: 26682 - protein, 129 aa, Homo sapiens
  Payload ID: 5261
  Gene Symbol: EFCAB1
  Gene Name: EF-hand calcium binding domain 1
  ENSP ID: ENSP00000430940
  MOD_RES (1)..(1): Any amino acid
XVNVLEWIHGLSLFLRGSLEEKMKYCFEVFDLNGDGFISKEEMFHMLKNSLLKQPSEEDPDEGIKDLVEITLKKMDHDHDGKLSFADYELAVREETLLLEAFGPCLPDPKSQMEFEAQVFKDPNEFNDM

SEQ ID NO: 26683 - protein, 131 aa, Homo sapiens
  Payload ID: 5262
  Gene Symbol: EFCAB10
  Gene Name: EF-hand calcium binding domain 10
  ENSP ID: ENSP00000417484
METSSRELQAAEYLEKHQIKEVVSYLTSALLFFRPEKPKEYLISLLERLRIAKVTGVAFPFFMDNSNIVAMFEMMDSSGRGTISFVQYKEALKTLGLCTEDEDLQDDGHKITLDKFKEEVNKRMKEIWSAF

SEQ ID NO: 26684 - protein, 149 aa, Homo sapiens
  Payload ID: 5262
  Gene Symbol: EFCAB10
  Gene Name: EF-hand calcium binding domain 10
  ENSP ID: ENSP00000417841
METSSRELQAAEYLEKHQIKEVVSYLTSALLFFRPEKPKEYLISLLERLRIAKVTGVAFPFFMDNSNIVAMFEMMDSSGRGTISFVQYKEALKTLGLCTEDEDLQDDGHKITLDKFKEEVNKRMKEICEKTKGKDSESYQTAAGLLLLH

SEQ ID NO: 26685 - protein, 76 aa, Homo sapiens
  Payload ID: 5262
  Gene Symbol: EFCAB10
  Gene Name: EF-hand calcium binding domain 10
  ENSP ID: ENSP00000418425
METSSRELQAAEYLEKHQIKEVVSYLTSALLFFRPALKTLGLCTEDEDLQDDGHKITLDKFKEEVNKRMKEIWSAF

SEQ ID NO: 26686 - protein, 127 aa, Homo sapiens
  Payload ID: 5262
  Gene Symbol: EFCAB10
  Gene Name: EF-hand calcium binding domain 10
  Uniprot ID: A6NFE3
  ENSP ID: ENSP00000418678
METSSRELQAAEYLEKHQIKEVVSYLTSALLFFRPEKPKEYLISLLERLRIAKVTGVAFPFFMDNSNIVAMFEMMDSSGRGTISFVQYKEALKTLGLCTEDEDLQDDGHKITLDKFKEEVNKRMKEI

SEQ ID NO: 26687 - protein, 163 aa, Homo sapiens
  Payload ID: 5263
  Gene Symbol: EFCAB11
  Gene Name: EF-hand calcium binding domain 11
  Uniprot ID: Q9BUY7
  ENSP ID: ENSP00000326267
MFFSEARARSRTWEASPSEHRKWVEVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFREVDRDSDGHVSFRDFEYALNYGQKEA

SEQ ID NO: 26688 - protein, 142 aa, Homo sapiens
  Payload ID: 5263
  Gene Symbol: EFCAB11
  Gene Name: EF-hand calcium binding domain 11
  Uniprot ID: Q9BUY7
  ENSP ID: ENSP00000438072
MFFSEARARSRTWEASPSEHRKWVEVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFRGIFSA

SEQ ID NO: 26689 - protein, 118 aa, Homo sapiens
  Payload ID: 5263
  Gene Symbol: EFCAB11
  Gene Name: EF-hand calcium binding domain 11
  Uniprot ID: Q9BUY7
  ENSP ID: ENSP00000452143
MVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFRGIFSA

SEQ ID NO: 26690 - protein, 139 aa, Homo sapiens
  Payload ID: 5263
  Gene Symbol: EFCAB11
  Gene Name: EF-hand calcium binding domain 11
  Uniprot ID: Q9BUY7
  ENSP ID: ENSP00000452320
MVFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFREVDRDSDGHVSFRDFEYALNYGQKEA

SEQ ID NO: 26691 - protein, 115 aa, Homo sapiens
  Payload ID: 5263
  Gene Symbol: EFCAB11
  Gene Name: EF-hand calcium binding domain 11
  Uniprot ID: Q9BUY7
  ENSP ID: ENSP00000452335
MLFGYKPSKIEVDSVMSSINPNTSGILLEGFLNIVRKKKEAQRYRNEVRHIFTAFDTYYRGFLTLEDFKKAFRQVAPKLPERTVLEVFREVDRDSDGHVSFRDFEYALNYGQKEA

SEQ ID NO: 26692 - protein, 61 aa, Homo sapiens
  Payload ID: 5263
  Gene Symbol: EFCAB11
  Gene Name: EF-hand calcium binding domain 11
  Uniprot ID: Q9BUY7
  ENSP ID: ENSP00000452397
MFFSEARARSRTWEASPSEHRKWVEVFKACDEDHKGYLSREDFKTAVVMLFGYKPSKKWIL

SEQ ID NO: 26693 - protein, 117 aa, Homo sapiens
  Payload ID: 5263
  Gene Symbol: EFCAB11
  Gene Name: EF-hand calcium binding domain 11
  ENSP ID: ENSP00000452403
VFKACDEDHKGYLSREDFKTAVVMLFGYKPSKIEVDSVMSSINPNTSGILLEGFLNIVRKKKEAQRYRNEVRHIFTAFDTYYRGFLTLEDFKKAFRQVAPKLPERTVLEVFRGIFSA

SEQ ID NO: 26694 - protein, 572 aa, Homo sapiens
  Payload ID: 5264
  Gene Symbol: EFCAB12
  Gene Name: EF-hand calcium binding domain 12
  Uniprot ID: Q6NXP0
  ENSP ID: ENSP00000324241
MDDDYEAYHSLFLSLLGLCPSKTPINENAPVFDPEPVIAHCFKQFQQKDFRLPQTRRRIIMVPRKEDQTPLNPASQPQAPPKPIPSFKVLEARDIQEQPEDRKTWLSQRSKLRQELESFGDVKRWLENKPSITPSEAKVLHMIHEEQSAQPNASQATTRTTRKKAPRLSRLSRQMVPQLQLPEPPALSVMYSYLHSRKIKILEIFHKVGQGENQRITREEFIAAVKAVGVPLKNQEVEDIVIYLSSLGKHNTITMDILANTYKQWSMAQQRSSLATAREHYILAKHRDSLKGPLKKQEVDSAPQLPKVDLLTVPAVDTQMETRPMTLEEMEEVGKRYRERQRQHKLTIPSIQYTEQCHLVRCGNRHFDEHCLPSTIHGDMRELIDSARRHNFLVYLQCWKLCKSYGLPLTEDILMKALLYPGDKIIFQMDKVCPIRQPGGYYSDWKVFSPNLALLRSQGPGKSKRTDKKTPKKSKKMRFKEFEEFTRKLKVKRSSGLQQTHPNSFWPGHLLDKLQLYLPTVATDRSLALFSCVQHQPHVYPATYHPDHWWPLRNKNYMTHAHYDAAKVYYIN

SEQ ID NO: 26695 - protein, 572 aa, Homo sapiens; identical to SEQ ID NO: 26694
  Payload ID: 5264
  Gene Symbol: EFCAB12
  Gene Name: EF-hand calcium binding domain 12
  Uniprot ID: Q6NXP0
  ENSP ID: ENSP00000420854

SEQ ID NO: 26696 - protein, 158 aa, Homo sapiens
  Payload ID: 5264
  Gene Symbol: EFCAB12
  Gene Name: EF-hand calcium binding domain 12
  ENSP ID: ENSP00000421462
MKRTTVCSCRCSKKAPRLSRLSRQMVPQLQLPEPPALSVMYSYLHSRKIKILEIFHKVGQGENQRITREEFIAAVKAVGVPLKNQEVEDIVIYLSSLGKHNTITMDILANTYKQWSMAQQRSSLATAREHYILAKHRDSLKGPLKKQEVDSAPQLPKV

SEQ ID NO: 26697 - protein, 973 aa, Homo sapiens
  Payload ID: 5265
  Gene Symbol: EFCAB13
  Gene Name: EF-hand calcium binding domain 13
  Uniprot ID: Q8IY85
  ENSP ID: ENSP00000332111
METKVHLFCQAEENIDLLDDGSNSFATDLSSGTINHKKYIKFSKTIEKEISPEIRSLSPEYKKIFETSIIFCGEEKSSDFSGEKKVGRKSLQVQQHSKRTEIIPPFLKLSKEKVTRKENSLCKLPNQYSVHKTSSPLCTSSAITREKEMLSNLYMTLYDEVTHGYLHSKELSALHKACKIFSKIRSGKIYVNDLPVILCILRISISDLEMRQALKTVDIDAFQDALKIFCRIKGGRVSTDDVFAVLDSMGIPINREILEEVTKHTYIDSNHMVDIGDIIFTLNELQEQYEDVSITEGSPLNEITSDRKLSSVAGCYLKYKKKNSLSSKLPEPSISKKLNKKSNQYYSKIMENDDLESKRPKNTWQIRKFLGGVGSSNVGVQEPYSKNGINFKKHSEKGEIHDSKSKPQSLKSSTSLSKSLDKSDISSIPKLQKPAVRKHSSLQKQVSSTEKTAISTLENFCEAISKLQENYIAAEELQSILPSTGINLLDEEFQKIVTDTSRNENGMVELDDFVNALAKERSFPECNALPGVIKAIDKIKDKNVDYEDLNTCLQNFGIYLSKPEFKKITELTEAGETKKVNFKEFIDTMMSNTECFSEKLVLPDAIETLDDLRKETMSVSDLWNTLSSLNSNLKKDEFLAALELVTVDEGDKVQFEEFAKVVRNMRDAARLEELQEVVLAADLLEGDMIAGKNLEDFLRNVGIKSPKEEVEKILQSDFVSEDNMVNIKDCMRALRDTQKFSNYIDFRKEASNLKLPKVNEIKEAANILSHVDNGKIGIPDLEHALKCLNVNLTEEDFNEALNCCNVSDNMEVDLKDFLMKMKESPHFQKSKATQILLATTQILQNDLVDVSDLKTLLMDKDLHTANAILTVMLRHVPEHESGKVSIQEFMTKLSDILTIPKAAGKFYLICTYCPDLERQAVVYMLKTIQDSIVKAQVSKKQYNMNIKQHKISLHNFCLNSKANIAKLNPNSKF

SEQ ID NO: 26698 - protein, 37 aa, Homo sapiens
  Payload ID: 5265
  Gene Symbol: EFCAB13
  Gene Name: EF-hand calcium binding domain 13
  ENSP ID: ENSP00000427910
METKVHLFCQAEENIDLLDDGSNSFATDLSSGTINHK

SEQ ID NO: 26699 - protein, 200 aa, Homo sapiens
  Payload ID: 5265
  Gene Symbol: EFCAB13
  Gene Name: EF-hand calcium binding domain 13
  ENSP ID: ENSP00000429566
EELQSILPSTGINLLDEEFQKIVTDTSRNENGMVELDDFVNALAKERSFPECNALPGVIKAIDKIKDKNVDYEDLNTCLQNFGIYLSKPEFKKITELTEAGETKKVNFKEFIDTMMSNTECFSEKLVLPDAIETLDDLRKETMSVSDLWNTLSSLNSNLKKDEFLAALELVTVDDNMEVDLKDFLMKMKESPHFQKSKGK

SEQ ID NO: 26700 - protein, 784 aa, Homo sapiens
  Payload ID: 5265
  Gene Symbol: EFCAB13
  Gene Name: EF-hand calcium binding domain 13
  Uniprot ID: Q8IY85
  ENSP ID: ENSP00000430048
METKVHLFCQAEENIDLLDDGSNSFATDLSSGTINHKKYIKFSKTIEKEISPEIRSLSPEYKKIFETSIIFCGEEKSSDFSGEKKVGRKSLQVQQHSKRTEIIPPFLKLSKEKVTRKENSLCKLPNQYSVHKTSSPLCTSSAITREKEMLSNLYMTLYDEVTHGYLHSKELSGNHMVDIGDIIFTLNELQEQYEDVSITEGSPLNEITSDRKLSSVAGCYLKYKKKNSLSSKLPEPSISKKLNKKSNQYYSKIMENDDLESKRPKNTWQIRKFLGGVGSSNVGVQEPYSKNGINFKKHSEKGEIHDSKSKPQSLKSSTSLSKSLDKSDISSIPKLQKPAVRKHSSLQKQVSSTEKTAISTLENFCEAISKLQENYIAAEELQSILPSTGINLLDEEFQKIVTDTSRNENGMVELDDFVNALAKERSFPECNALPGVIKAIDKIKDKNVDYEDLNTCLQNFGIYLSKPEFKKITELTEAGETKKVNFKEFIDTMMSNTECFSEKLVLPDAIETLDDLRKETMSVSDLWNTLSSLNSNLKKDEFLAALELVTVDEGDKVQFEEFAKVVRNMRDAARLEELQEVVLAADLLEGDMIAGKNLEDFLRNVGIKSPKEEVEKILQSDFVSEDNMVNIKDCMRALRDTQKFSNYIDFRKEASNLKLPKVNEIKEAANILSHVDNGKIGIPDLEHALKCLNVNLTEEDFNEALNCCNVSDNMEVDLKDFLMKMKESPHFQKSKATQILLATTQILQNDLVDVSDLKTLLMDKDLHTANAILTVMLRHVPEHG

SEQ ID NO: 26701 - protein, 53 aa, Homo sapiens
  Payload ID: 5265
  Gene Symbol: EFCAB13
  Gene Name: EF-hand calcium binding domain 13
  ENSP ID: ENSP00000430802
METKVHLFCQAEENIDLLDDGSNSFATDLSSGTINHKKYIKFSKTIEKEISPE

SEQ ID NO: 26702 - protein, 104 aa, Homo sapiens
  Payload ID: 5265
  Gene Symbol: EFCAB13
  Gene Name: EF-hand calcium binding domain 13
  ENSP ID: ENSP00000466136
MLSNLYMTLYDEVTHGYLHSKELSGNHMVDIGDIIFTLNELQEQYEDVSITEGSPLNEITSDRKLSSVAGCYLKYKKKNSLSSKLPEPSISKKLNKKSNQYYSK

SEQ ID NO: 26703 - protein, 6 aa, Homo sapiens
  Payload ID: 5265
  Gene Symbol: EFCAB13
  Gene Name: EF-hand calcium binding domain 13
  ENSP ID: ENSP00000467325
METKVH

SEQ ID NO: 26704 - protein, 495 aa, Homo sapiens
  Payload ID: 5266
  Gene Symbol: EFCAB14
  Gene Name: EF-hand calcium binding domain 14
  Uniprot ID: O75071
  ENSP ID: ENSP00000361001
MKKRKELNALIGLAGDSRRKKPKKGPSSHRLLRTEPPDSDSESSSEEEEEFGVVGNRSRFAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQDILYLHNSLEEVNSALVGYQRQNDLKLEGMNETVSNLTQRVNLIESDVVAMSKVEKKANLSFSMMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEDLQDLFRKTGQDVDGKLTYQEIWTSLGSAMPEPESLRAFDSDGDGRYSFLELRVALGI

SEQ ID NO: 26705 - protein, 66 aa, Homo sapiens
  Payload ID: 5266
  Gene Symbol: EFCAB14
  Gene Name: EF-hand calcium binding domain 14
  ENSP ID: ENSP00000474599
  MOD_RES (1)..(1): Any amino acid
XATSELDNKTHSENLKQMGDRSATLKRQSLDQVTNRTDTVKIQSIKFCHQLTHHQGETEERSGENL

SEQ ID NO: 26706 - protein, 221 aa, Homo sapiens
  Payload ID: 5267
  Gene Symbol: EFCAB2
  Gene Name: EF-hand calcium binding domain 2
  ENSP ID: ENSP00000355478
  MOD_RES (1)..(1): Any amino acid
XAGTPRPRLSLGISQATGSAARWRTRRTGKGLGYNSDEIRPRTLLIEHLMEGGRRDHHTMTVLWGTQEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEGEPFSQEEMEEMLSAAIDPESNSINYKDYITMMVIDEN

SEQ ID NO: 26707 - protein, 269 aa, Homo sapiens
  Payload ID: 5267
  Gene Symbol: EFCAB2
  Gene Name: EF-hand calcium binding domain 2
  Uniprot ID: Q5VUJ9
  ENSP ID: ENSP00000355479
MLGPGQVRLRPRVWRDKAGGRVADGASGLPPARGSWRETGTGRALGASSPPRPAQGSSSPGIQSGPSSRPGSPRGAEQAGTPRPRLSLGISQATGSAARWRTRRTGKGLGYNSDEIRPRTLLIEHLMEGGRRDHHTMTVLWGTQEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEDGVSLRRPG

SEQ ID NO: 26708 - protein, 162 aa, Homo sapiens
  Payload ID: 5267
  Gene Symbol: EFCAB2
  Gene Name: EF-hand calcium binding domain 2
  Uniprot ID: Q5VUJ9
  ENSP ID: ENSP00000355480
MADEKDREEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEGEPFSQEEMEEMLSAAIDPESNSINYKDYITMMVIDEN

SEQ ID NO: 26709 - protein, 52 aa, Homo sapiens
  Payload ID: 5267
  Gene Symbol: EFCAB2
  Gene Name: EF-hand calcium binding domain 2
  ENSP ID: ENSP00000397120
  MOD_RES (1)..(1): Any amino acid
XEDVLLRAFEVLDSAKRGFLTKDELIKYMTEEGGVVITPILETGKLRWGAVK

SEQ ID NO: 26710 - protein, 127 aa, Homo sapiens
  Payload ID: 5267
  Gene Symbol: EFCAB2
  Gene Name: EF-hand calcium binding domain 2
  ENSP ID: ENSP00000405269
  MOD_RES (1)..(1): Any amino acid
XIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEETGKLRWGAVK

SEQ ID NO: 26711 - protein, 133 aa, Homo sapiens
  Payload ID: 5267
  Gene Symbol: EFCAB2
  Gene Name: EF-hand calcium binding domain 2
  Uniprot ID: Q5VUJ9
  ENSP ID: ENSP00000408661
MADEKDREEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEDGVSLRRPG

SEQ ID NO: 26712 - protein, 131 aa, Homo sapiens
  Payload ID: 5267
  Gene Symbol: EFCAB2
  Gene Name: EF-hand calcium binding domain 2
  ENSP ID: ENSP00000447807
  MOD_RES (1)..(1): Any amino acid
XIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEGKCDLLLITMTYVRN

SEQ ID NO: 26713 - protein, 438 aa, Homo sapiens
  Payload ID: 5268
  Gene Symbol: EFCAB3
  Gene Name: EF-hand calcium binding domain 3
  Uniprot ID: Q8N7B9
  ENSP ID: ENSP00000302649
MAVSEIKPKLKLNPLTKVPISHNKRDRDLPGSLQCQLQHKEKKLSASQMAAFQDAYNFFYKDKTGCIDFHGLMCTVAKLGMNLTKHDVYNELKCADIDRDGKVNFSDFIKVLTDKNLFLKAVVPEKETCLDLAGNPGILLFEILSRLLETSALPRKSIIEIVSYFQRKFQHTGPGMLWSPYTMGYGKRTLKPDICTPPSSSMAAFANAARIAIMKEKDLFKFLEELKRCNSGSDSPYSKIPIFPLFPNVDGVVMGKPFKDMQKLEMLRIKEPLHFFEDYFFHKRDWKTQAANIKSMDPASGYSNNIFTIDQMLKKKQTCTVADATAIKQHVKRATDTYNLGIALEHRKEMLNLWQKIRGDLIGMDSRNESFYDTFSTYTWSWNVCQELLSPKDLRLYDAYVNRNSSHNSRSSSSSDTSECYTDSGRKRKRKGLKGFQQ

SEQ ID NO: 26714 - protein, 490 aa, Homo sapiens
  Payload ID: 5268
  Gene Symbol: EFCAB3
  Gene Name: EF-hand calcium binding domain 3
  Uniprot ID: Q8N7B9
  ENSP ID: ENSP00000403932
MKELMPHLTFNGNGKINVNSIMEGLKKFKPKGMVTLHKLKTANDIKDRVTGHMAVSEIKPKLKLNPLTKVPISHNKRDRDLPGSLQCQLQHKEKKLSASQMAAFQDAYNFFYKDKTGCIDFHGLMCTVAKLGMNLTKHDVYNELKCADIDRDGKVNFSDFIKVLTDKNLFLKAVVPEKETCLDLAGNPGILLFEILSRLLETSALPRKSIIEIVSYFQRKFQHTGPGMLWSPYTMGYGKRTLKPDICTPPSSSMAAFANAARIAIMKEKDLFKFLEELKRCNSGSDSPYSKIPIFPLFPNVDGVVMGKPFKDMQKLEMLRIKEPLHFFEDYFFHKRDWKTQAANIKSMDPASGYSNNIFTIDQMLKKKQTCTVADATAIKQHVKRATDTYNLGIALEHRKEMLNLWQKIRGDLIGMDSRNESFYDTFSTYTWSWNVCQELLSPKDLRLYDAYVNRNSSHNSRSSSSSDTSECYTDSGRKRKRKGLKGFQQ

SEQ ID NO: 26715 - protein, 162 aa, Homo sapiens
  Payload ID: 5268
  Gene Symbol: EFCAB3
  Gene Name: EF-hand calcium binding domain 3
  ENSP ID: ENSP00000428626
MAVSEIKPKLKLNPLTKVPISHNKRDRDLPGSLQCQLQHKEKKLSASQMAAFQDAYNFFYKDKTGCIDFHGLMCTVAKLGMNLTKHDVYNELKCADIDRDGKVNFSDFIKVLTDKNLFLKAVVPEKETCLDLAGNPGILLFEILSRLLETSALPRKSIIEIV

SEQ ID NO: 26716 - protein, 174 aa, Homo sapiens
  Payload ID: 5268
  Gene Symbol: EFCAB3
  Gene Name: EF-hand calcium binding domain 3
  ENSP ID: ENSP00000429124
MAVSEIKPKLKLNPLTKVPISHNKRDRDLPGSLQCQLQHKEKKLSASQMAAFQDAYNFFYKDKTGCIDFHGLMCTVAKLGMNLTKHDVYNELKCADIDRDGKVNFSDFIKVLTDKNLFLKAVVPEKETCLDLAGNPGILLFEILSRLLETSALPRKSIIEIVSYFQRKFQHTGP

SEQ ID NO: 26717 - protein, 1503 aa, Homo sapiens
  Payload ID: 5269
  Gene Symbol: EFCAB5
  Gene Name: EF-hand calcium binding domain 5
  Uniprot ID: A4FU69
  ENSP ID: ENSP00000378312
MNESASQEELRPAQENRKEDKERKWNLTEVKELHETLQSVPDVPVKEDTNSVVEKAMDEIKSQELNLEGQRKISPGSIKDSKTEASGNIAIRKSAKVIFALDETELKSKPEHTWKKNLFERMEARAQAMQQKIIDKENLKKELEKKAEKKLPRDNLAKEWFNTDSMTLNNTAYLLDKLLPTLVPGVENMLTQVEKKKVLTEADTPSKFDPINYLGEYLIRNNPNYIKDPGMSGYQRLMKEVTEDLKIYVPDTICNRVSKMKENVKQNRKQRESIDKIIVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTDLHSIIRNIQSCKEVKGRTAFNGVSFNLLQFVQLLETFVGEDAPLSVSETLTSFFKEGYVETEQEKMNALEQFSQNAFQVRQRLLLEAIFQKWDSDGSGFLDLKEVDELLYTYKEGMEKESMKKAKLHIQFPKPHPGHEVRLSSKQFQNYIELVVSELRGNEDQVLESVVEFLMNALERSHIESLRNSARRKWLHQIQCAAETSGVSLEPVYSETFKALMQDAEAHGNKKISAHISLLEENLLLPEKGNVLLRNVACTLDDAQFVLNRVLYRDMKGISFTVVDEGKPIHVPQVQYHGNIFFWNQSRNKHDYNGSFLALPLQDAYMRIFGVLAVDTLRDPHEINIFLPHEIRFYQGVANVFSTAYHYVHSREHILHIVITGIGWLYDVTSSITSITTYFVEPSPAQDSDYVLRNMMVTGQLGLTEIHKNPPTIHRKSCIFRDFLFKCTDSSEVVLASACGETHIVVPLRERTGEALGVLDFNIGQNRMLLCQEYKDLQKMMKVVQVACYEILGEFSGEIKKKYILEIENVREVQRAGILFFRIMLLELQESIQLLNSMEFVSLLLYDHTLVTEPNSPQDSKSMELEANVKLVRDILKAVILFFHPELEFSSDFGSWDKCKFYVNKYLVNNICAFDPTAKHVEVNVQLIDEYIRDHSRTEVWKFGNVVIEHLYHWIHICSALMKITKQLNSGITPPLPSKTDNYMYAKMPGEGLQEK

SEQ ID NO: 26718 - protein, 56 aa, Homo sapiens
  Payload ID: 5269
  Gene Symbol: EFCAB5
  Gene Name: EF-hand calcium binding domain 5
  ENSP ID: ENSP00000392831
MDEIKSQELNLEGQRKISPGSIKDSKTEASDSECSSRILSKSRFQAWITLQTTGYY

SEQ ID NO: 26719 - protein, 926 aa, Homo sapiens
  Payload ID: 5269
  Gene Symbol: EFCAB5
  Gene Name: EF-hand calcium binding domain 5
  Uniprot ID: A4FU69
  ENSP ID: ENSP00000393095
MNESASQEELRPAQENRKEDKERKWNLTEVKELHETLQSVPDVPVKEDTNSVVEKAMDEIKSQELNLEGQRKISPGSIKDSKTEASGNIAIRKSAKVIFALDETELKSKPEHTWKKNLFERMEARAQAMQQKIIDKENLKKELEKKAEKKLPRDNLAKEWFNTDSMTLNNTAYLLDKLLPTLVPGVENMLTQVEKKKVLTEADTPSKFDPINYLGEYLIRNNPNYIKDPGMSGYQRLMKEVTEDLKIYVPDTICNRVSKMKENVKQNRKQRESIDKIIVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTDLHSIIRNIQSCKEVKGRTAFNGVSFNLLQFVQLLETFVGEDAPLSVSETLTSFFKEGYVETEQEKMNALEQFSQNAFQVRQRLLLEAIFQKWDSDGSGFLDLKEVDELLYTYKEGMEKESMKKGLTLSPGWSAVAQL

SEQ ID NO: 26720 - protein, 103 aa, Homo sapiens
  Payload ID: 5269
  Gene Symbol: EFCAB5
  Gene Name: EF-hand calcium binding domain 5
  ENSP ID: ENSP00000400023
MDEIKSQELNLEGQRKISPGSIKDSKTEASGNIAIRKSAKVIFALDETELKSKPEHTWKKNLFERMEARAQAMQQKIIDKENLKKELEKKAEKKLPRDNLAKE

SEQ ID NO: 26721 - protein, 1185 aa, Homo sapiens
  Payload ID: 5269
  Gene Symbol: EFCAB5
  Gene Name: EF-hand calcium binding domain 5
  ENSP ID: ENSP00000417009
KKKVLTEADTPSKFDPINYLGEYLIRNNPNYIKDPGMSGYQRLMKEVTEDLKIYVPDTICNRVSKMKENVKQNRKQRESIDKIIVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTAKLHIQFPKPHPGHEVRLSSKQFQNYIELVVSELRGNEDQVLESVVEFLMNALERSHIESLRNSARRKWLHQIQCAAETSGVSLEPVYSETFKALMQDAEAHGNKKISAHISLLEENLLLPEKGNVLLRNVACTLDDAQFVLNRVLYRDMKGISFTVVDEGKPIHVPQVQYHGNIFFWNQSRNKHDYNGSFLALPLQDAYMRIFGVLAVDTLRDPHEINIFLPHEIRFYQGVANVFSTAYHYVHSREHILHIVITGIGWLYDVTSSITSITTYFVEPSPAQDSDYVLRNMMVTGQLGLTEIHKNPPTIHRKSCIFRDFLFKCTDSSEVVLASACGETHIVVPLRERTGEALGVLDFNIGQNRMLLCQEYKDLQKMMKVVQVACYEILGEFSGEIKKKYILEIENVREVQRAGILFFRIMLLELQESIQLLNSMEFVSLLLYDHTLVTEPNSPQDSKSMELEANVKLVRDILKAVILFFHPELEFSSDFGSWDKCKFYVNKYLVNNICAFDPTAKHVEVNVQLIDEYIRDHSRTEVWKFGNVVIEHLYHWIHICSALMKITKQLNSGITPPLPSKTDNYMYAKMPGEGLQEK

SEQ ID NO: 26722 - protein, 856 aa, Homo sapiens
  Payload ID: 5269
  Gene Symbol: EFCAB5
  Gene Name: EF-hand calcium binding domain 5
  Uniprot ID: A4FU69
  ENSP ID: ENSP00000440619
MDEIKSQELNLEGQRKISPGSIKDSKTEASGNIAIRKSAKVIFALDETELKSKPEHTWKKNLFERMEARAQAMQQKIIDKENLKKELEKKAEKKLPRDNLAKEWFNTDSMTLNNTAYLLDKLLPTLVPGVENMLTQVEKKKVLTEADTPSKFDPINYLGEYLIRNNPNYIKDPGMSGYQRLMKEVTEDLKIYVPDTICNRVSKMKENVKQNRKQRESIDKIIVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTDLHSIIRNIQSCKEVKGRTAFNGVSFNLLQFVQLLETFVGEDAPLSVSETLTSFFKEGYVETEQEKMNALEQVSLCRQAGVQWRNCSSLQPPTPGLKRSSHHRLLSNWDYRERRKFFPLETKFP

SEQ ID NO: 26723 - protein, 774 aa, Homo sapiens
  Payload ID: 5269
  Gene Symbol: EFCAB5
  Gene Name: EF-hand calcium binding domain 5
  ENSP ID: ENSP00000465109
  MOD_RES (1)..(1): Any amino acid
XDTPSKFDPINYLGEYLIRNNPNYIKDPGMSGYQRLMKEVTEDLKIYVPDTICNRVSKMKENVKQNRKQRESIDKIIVKVANTRKQALQEQFDEWILDPKGMIPKSVIQNVLQEFFQNPDFKLGSHCKQLDITDSTEPRLNKMEFTEYISSHIKDLKSEMFEELLKHLCHSADEFREVIKADMRRQMFAELFLHCDHGKVGFLDRQRTLALLELFYDHSSQMLRSLLRNPRQWPFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSSRRLLTEQETHRESTTEQGQHKGSIEGQGPRRVSVSEQGSSRESVAEQGSRRESIAEQDRHKGSVAEQGSRRMSAAEQGSLRESVIEEPYQKSEQGPYGEIISEEQEDIGSTSQSRKDSILKSTKYGEPITSEYIEVPLQEKRSWEQTYEEEIFLSSELQEEVPTLSRKDHFPETTKKEVQKDKPCEPKSQKIEGKSWSGEFFTCNWKMKYVTFEDEEQANLIYGNSRFTDLHSIIRNIQSCKEVKGRTAFNGVSFNLLQFVQLLETFVGEDAPLSVSETLTSFFKEGYVETEQEKMNALEQFSQNAFQVRQRLLLEAIFQKWDSDGSGFLDLKEVDELLYTYKEGMEKESMKKDHSRTEVWKFGNVVIEHLYHWIHICSALMKITKQLNSGITPPLPSKTDNYMYAKMPGEGLQEK

SEQ ID NO: 26724 - protein, 1501 aa, Homo sapiens
  Payload ID: 5270
  Gene Symbol: EFCAB6
  Gene Name: EF-hand calcium binding domain 6
  Uniprot ID: Q5THR3
  ENSP ID: ENSP00000262726
MCKMAIIPDWLRSHPHTRKFTHSRPHSSPCRVYSRNGSPNKFRSSSTTAVANPTLSSLDVKRILFQKITDRGDELQKAFQLLDTGQNLTVSKSELRRIITDFLMPLTREQFQDVLAQIPLSTSGTVPYLAFLSRFGGIDLYINGIKRGGGNEMNCCRTLRELEIQVGEKVFKNIKTVMKAFELIDVNKTGLVRPQELRRVLETFCMKLRDEEYEKFSKHYNIHKDTAVDYNVFLKNLSINNDLNLRYCMGNQEVSLENQQAKNSKKERLLGSASSEDIWRNYSLDEIERNFCLQLSKSYEKVEKALSAGDPCKGGYVSFNYLKIVLDTFVYQIPRRIFIQLMKRFGLKATTKINWKQFLTSFHEPQGLQVSSKGPLTKRNSINSRNESHKENIITKLFRHTEDHSASLKKALLIINTKPDGPITREEFRYILNCMAVKLSDSEFKELMQMLDPGDTGVVNTSMFIDLIEENCRMRKTSPCTDAKTPFLLAWDSVEEIVHDTITRNLQAFYNMLRSYDLGDTGRIGRNNFKKIMHVFCPFLTNAHFIKLCSKIQDIGSGRILYKKLLACIGIDGPPTVSPVLVPKDQLLSEHLQKDEQQQPDLSERTKLTEDKTTLTKKMTTEEVIEKFKKCIQQQDPAFKKRFLDFSKEPNGKINVHDFKKVLEDTGMPMDDDQYALLTTKIGFEKEGMSYLDFAAGFEDPPMRGPETTPPQPPTPSKSYVNSHFITAEECLKLFPRRLKESFRDPYSAFFKTDADRDGIINMHDLHRLLLHLLLNLKDDEFERFLGLLGLRLSVTLNFREFQNLCEKRPWRTDEAPQRLIRPKQKVADSELACEQAHQYLVTKAKNRWSDLSKNFLETDNEGNGILRRRDIKNALYGFDIPLTPREFEKLWARYDTEGKGHITYQEFLQKLGINYSPAVHRPCAEDYFNFMGHFTKPQQLQEEMKELQQSTEKAVAARDKLMDRHQDISKAFTKTDQSKTNYISICKMQEVLEECGCSLTEGELTHLLNSWGVSRHDNAINYLDFLRAVENSKSTGAQPKEKEESMPINFATLNPQEAVRKIQEVVESSQLALSTAFSALDKEDTGFVKATEFGQVLKDFCYKLTDNQYHYFLRKLRIHLTPYINWKYFLQNFSCFLEETADEWAEKMPKGPPPTSPKATADRDILARLHKAVTSHYHAITQEFENFDTMKTNTISREEFRAICNRRVQILTDEQFDRLWNEMPVNAKGRLKYPDFLSRFSSETAATPMATGDSAVAQRGSSVPDVSEGTRSALSLPTQELRPGSKSQSHPCTPASTTVIPGTPPLQNCDPIESRLRKRIQGCWRQLLKECKEKDVARQGDINASDFLALVEKFNLDISKEECQQLIIKYDLKSNGKFAYCDFIQSCVLLLKAKESSLMHRMKIQNAHKMKEAGAETPSFYSALLRIQPKIVHCWRPMRRTFKSYDEAGTGLLSVADFRTVLRQYSINLSEEEFFHILEYYDKTLSSKISYNDFLRAFLQ

SEQ ID NO: 26725 - protein, 200 aa, Homo sapiens
  Payload ID: 5270
  Gene Symbol: EFCAB6
  Gene Name: EF-hand calcium binding domain 6
  ENSP ID: ENSP00000348391
MVPQISSDLLQIPLSTSGTVPYLAFLSRFGGIDLYINGIKRGGGNEMNCCRTLRELEIQVGEKVFKNIKTVMKAFELIDVNKTGLVRPQELRRVLETFCMKLRDEEYEKFSKHYNIHKDTAVDYNVFLKNLSINNDLNLRYCMGNQEVSLENQQAKNSKKERLLGSASSEDIWRNYSLDEIERNFCLQVRCFPKPQLPTE

SEQ ID NO: 26726 - protein, 1349 aa, Homo sapiens
  Payload ID: 5270
  Gene Symbol: EFCAB6
  Gene Name: EF-hand calcium binding domain 6
  Uniprot ID: Q5THR3
  ENSP ID: ENSP00000379533
MNCCRTLRELEIQVGEKVFKNIKTVMKAFELIDVNKTGLVRPQELRRVLETFCMKLRDEEYEKFSKHYNIHKDTAVDYNVFLKNLSINNDLNLRYCMGNQEVSLENQQAKNSKKERLLGSASSEDIWRNYSLDEIERNFCLQLSKSYEKVEKALSAGDPCKGGYVSFNYLKIVLDTFVYQIPRRIFIQLMKRFGLKATTKINWKQFLTSFHEPQGLQVSSKGPLTKRNSINSRNESHKENIITKLFRHTEDHSASLKKALLIINTKPDGPITREEFRYILNCMAVKLSDSEFKELMQMLDPGDTGVVNTSMFIDLIEENCRMRKTSPCTDAKTPFLLAWDSVEEIVHDTITRNLQAFYNMLRSYDLGDTGRIGRNNFKKIMHVFCPFLTNAHFIKLCSKIQDIGSGRILYKKLLACIGIDGPPTVSPVLVPKDQLLSEHLQKDEQQQPDLSERTKLTEDKTTLTKKMTTEEVIEKFKKCIQQQDPAFKKRFLDFSKEPNGKINVHDFKKVLEDTGMPMDDDQYALLTTKIGFEKEGMSYLDFAAGFEDPPMRGPETTPPQPPTPSKSYVNSHFITAEECLKLFPRRLKESFRDPYSAFFKTDADRDGIINMHDLHRLLLHLLLNLKDDEFERFLGLLGLRLSVTLNFREFQNLCEKRPWRTDEAPQRLIRPKQKVADSELACEQAHQYLVTKAKNRWSDLSKNFLETDNEGNGILRRRDIKNALYGFDIPLTPREFEKLWARYDTEGKGHITYQEFLQKLGINYSPAVHRPCAEDYFNFMGHFTKPQQLQEEMKELQQSTEKAVAARDKLMDRHQDISKAFTKTDQSKTNYISICKMQEVLEECGCSLTEGELTHLLNSWGVSRHDNAINYLDFLRAVENSKSTGAQPKEKEESMPINFATLNPQEAVRKIQEVVESSQLALSTAFSALDKEDTGFVKATEFGQVLKDFCYKLTDNQYHYFLRKLRIHLTPYINWKYFLQNFSCFLEETADEWAEKMPKGPPPTSPKATADRDILARLHKAVTSHYHAITQEFENFDTMKTNTISREEFRAICNRRVQILTDEQFDRLWNEMPVNAKGRLKYPDFLSRFSSETAATPMATGDSAVAQRGSSVPDVSEGTRSALSLPTQELRPGSKSQSHPCTPASTTVIPGTPPLQNCDPIESRLRKRIQGCWRQLLKECKEKDVARQGDINASDFLALVEKFNLDISKEECQQLIIKYDLKSNGKFAYCDFIQSCVLLLKAKESSLMHRMKIQNAHKMKEAGAETPSFYSALLRIQPKIVHCWRPMRRTFKSYDEAGTGLLSVADFRTVLRQYSINLSEEEFFHILEYYDKTLSSKISYNDFLRAFLQ

SEQ ID NO: 26727 - protein, 629 aa, Homo sapiens
  Payload ID: 5271
  Gene Symbol: EFCAB7
  Gene Name: EF-hand calcium binding domain 7
  Uniprot ID: A8K855
  ENSP ID: ENSP00000360129
MAISPRSDATFSSQKSTPSESPRTKKFPLTEEEIFYMNCRAAYLTVFKSSLENIISKDQLYLALQHAGRNPSQKTINKYWTPQTAKLNFDDFCIILRKEKPTSKAELLKSFKQLDVNDDGCILHTDLYKFLTKRGEKMTREEVNAIINLADVNADGKFDYIKFCKLYMTTNEQCLKTTLEKLEVDSKLMRHQFGNHIEGSPERDPSPVPKPSPKITRKTDPETFLNKGDTRSSLLSATRKFKTSVSFTVTMGANGNRNSKLMEPNLIKDWQHMQSKGCFFLEEDGEIISHQYRMQIAQRSMVYLTIKPLNLSQVEGKPSPWLSVDTALYILKENESQANLQLVCFTELRNREVFGWTGELGPGIYWLIPSTTGCRLRKKIKPVTDEAQLVYRDETGELFLTKEFKSTLSDIFEVIDLDGNGLLSLEEYNFFELRTSGEKCDEDAWAVCRENFDTKRNELTRQGFMDLNLMEANDREGDPCDLWVTLHSMGYNKALELTEACPFVIDIYAEKCKPKIKAVHMEACSGQLEKAICKSVLSNGDAKVMDGYENIIVHTYSCDTWITSVIENKSDEKVIIHISNELSKNCINNRGLNIFAVEVGPKSTMVCQHVMPLNERQEWIYYCIYSLIS

SEQ ID NO: 26728 - protein, 1288 aa, Homo sapiens
  Payload ID: 5272
  Gene Symbol: EFCAB8
  Gene Name: EF-hand calcium binding domain 8
  ENSP ID: ENSP00000383366
MSSEDLAEIPQLQKLSIPHGFQNKEAASSPTPSITLSQVPDLQPGSQLFTEIHLAKIEKMFEEDINSTGALGMDAFIKAMKKVLSSVSDEMLKELFLKVDSDCEGFVTWQKYVDYMMREFQGKEDMRKSQYRLHFYLPMTVVPLNHGCEVVKVVFLIHRFKKIGCFLTVTKDGILQFWSESFSLMSSFRLNQTQQLYNQPMWVIDMVCLHNMNLVAVASTRQKIDFFDISDHKCVRAFTFVDLDSCALVMDYWSDYHRGVFCYGDAKGNVIVFTSENMTSGLFNPRILPRASKWDHWIKVSLQKLLNEKSALHRSYRLKALHPNWCEQVKFIPQMNVVVSCSAIEKSSLVLTILPAKASKKPRLSVLRLRKGILCFDYCPDRNFLVTGGYDAFIRLWNPFVSKRPVWLMKGHQTSVTHILVDSRNNSILISVSKDKNIRVWDMLDYICLQSFCGKFFALGNCPITSAYFFEKDNTLICSTYSIGILKGYLEAQGLIKARKRTTHCSPLCAVLYSKIFKQVVSGCLRGTVSVWEVVTGRKTMEFAVSGGQHVEMTAMALDESERCLLTGLRDGTMKMWNYNIGKCLLTFPSPEQLEISGIIHMNKVFYVTGWSKRITHFLFHKTKPVLLCYHWQTYHTEDILSMAKYRNQFLGTSSYSGDILFWNTGTLKPIFNFNASRSPSPLQPKRVQDVNNCLAESHRPSRPYVEREKWTYKTSRKLSSLSPESVANTNLRRSLVSAPPVMRCPRDKEPDRPVPQQKPSSASGTSRQSSKIHSKQSIYKEDETRKGEWQKNMLVQSSASVEKIIFLQTRPRLPHTAALLSSCMDGYIYAWSLHENGGLLGKFPVDLDNGDVVVGAMATDKNDWILITGDCKGYIKIWDIKDYCALIDKQPFQSSGAKVVSEAHNKFRLLIPQQLGTNFPHYIPLEDKEVVAGHTISLVPPTLLMTWKGHLNSVADILYVDNFQLVISAGQDRDVKAWKLSGDAIGTFGLSVWKRLQDACDGPRENRASLEEDGDSTGTTQKVLHLELQEQRDLAEALIYQRREQAALMALLHGKADKEADTWAKLQKMALMSPWAGERPLEDIEDSWNKWESRDKQVSKVLGAAYKPKERLQNTRFLSTRVPYGWMKHQISPQVYQSLHFSDLMPTQQPDFLTSRGPDQQDQHIRLVAHHVQKDLVPSREQAVLDTTDSTPAAASSPSSLLSVTASASRLLDSSLPTFLTPQFSFLLRPQSASTAHSTPSVPSPVSKSTLQGSVTPKHIVSSFERPPRPLKATFMSSVKGSSHVRF

SEQ ID NO: 26729 - protein, 144 aa, Homo sapiens
  Payload ID: 5272
  Gene Symbol: EFCAB8
  Gene Name: EF-hand calcium binding domain 8
  Uniprot ID: A8MWE9
  ENSP ID: ENSP00000481567
MSSEDLAEIPQLQKLSIPHGFQNKEAASSPTPSITLSQVPDLQPGSQLFTEIHLAKIEKMFEEDINSTGALGMDAFIKAMKKVLSSVSDEMLKELFLKVDSDCEGFVTWQKYVDYMMREFQGKEDMRKSQYRLHFYLPMTVVPL

SEQ ID NO: 26730 - protein, 197 aa, Homo sapiens
  Payload ID: 5273
  Gene Symbol: EFCAB9
  Gene Name: EF-hand calcium binding domain 9
  Uniprot ID: A8MZ26
  ENSP ID: ENSP00000381247
MRLKQGSFLWYLYLDKIYCLLSVRNVKALAEYFHILDVHGKNTLNDVLFYHFLHHVTDLKKAQINIVFDMLDWNAVGEIDFEKFYMLVCMLLAHQNHLEGQFMYRHSRPVFDLLDLKGDLRIGAKNFEMYRFLFNIQKQELKDLFRDFDITGDNRLNYQEFKLYTIIYTDKLQKRQKTEEKEKGERKRSLYSKCHIK

SEQ ID NO: 26731 - protein, 640 aa, Homo sapiens
  Payload ID: 5274
  Gene Symbol: EFHC1
  Gene Name: EF-hand domain (C-terminal) containing 1
  Uniprot ID: Q5JVL4
  ENSP ID: ENSP00000360107
MVSNPVHGLPFLPGTSFKDSTKTAFHRSQTLSYRNGYAIVRRPTVGIGGDRLQFNQLSQAELDELASKAPVLTYGQPKQAPPADFIPAHVAFDKKVLKFDAYFQEDVPMSTEEQYRIRQVNIYYYLEDDSMSVIEPVVENSGILQGKLIKRQRLAKNDRGDHYHWKDLNRGINITIYGKTFRVVDCDQFTQVFLESQGIELNPPEKMALDPYTELRKQPLRKYVTPSDFDQLKQFLTFDKQVLRFYAIWDDTDSMYGECRTYIIHYYLMDDTVEIREVHERNDGRDPFPLLMNRQRVPKVLVENAKNFPQCVLEISDQEVLEWYTAKDFIVGKSLTILGRTFFIYDCDPFTRRYYKEKFGITDLPRIDVSKREPPPVKQELPPYNGFGLVEDSAQNCFALIPKAPKKDVIKMLVNDNKVLRYLAVLESPIPEDKDRRFVFSYFLATDMISIFEPPVRNSGIIGGKYLGRTKVVKPYSTVDNPVYYGPSDFFIGAVIEVFGHRFIILDTDEYVLKYMESNAAQYSPEALASIQNHVRKREAPAPEAESKQTEKDPGVQELEALIDTIQKQLKDHSCKDNIREAFQIYDKEASGYVDRDMFFKICESLNVPVDDSLVKELIRMCSHGEGKINYYNFVRAFSN

SEQ ID NO: 26732 - protein, 278 aa, Homo sapiens
  Payload ID: 5274
  Gene Symbol: EFHC1
  Gene Name: EF-hand domain (C-terminal) containing 1
  Uniprot ID: Q5JVL4
  ENSP ID: ENSP00000434498
MVSNPVHGLPFLPGTSFKDSTKTAFHRSQTLSYRNGYAIVRRPTVGIGGDRLQFNQLSQAELDELASKAPVLTYGQPKQAPPADFIPAHVAFDKKVLKFDAYFQEDVPMSTEEQYRIRQVNIYYYLEDDSMSVIEPVVENSGILQGKLIKRQRLAKNDRGDHYHWKDLNRGINITIYGKTFRVVDCDQFTQVFLESQGIELNPPEKMALDPYTELRKQPLRKYVTPSDFDQLKQFLTFDKQVSDIGTTIGLLISKCDLHLLAKGLGSCIGNYFETLQL

SEQ ID NO: 26733 - protein, 621 aa, Homo sapiens
  Payload ID: 5274
  Gene Symbol: EFHC1
  Gene Name: EF-hand domain (C-terminal) containing 1
  Uniprot ID: Q5JVL4
  ENSP ID: ENSP00000444521
MLKTAFHRSQTLSYRNGYAIVRRPTVGIGGDRLQFNQLSQAELDELASKAPVLTYGQPKQAPPADFIPAHVAFDKKVLKFDAYFQEDVPMSTEEQYRIRQVNIYYYLEDDSMSVIEPVVENSGILQGKLIKRQRLAKNDRGDHYHWKDLNRGINITIYGKTFRVVDCDQFTQVFLESQGIELNPPEKMALDPYTELRKQPLRKYVTPSDFDQLKQFLTFDKQVLRFYAIWDDTDSMYGECRTYIIHYYLMDDTVEIREVHERNDGRDPFPLLMNRQRVPKVLVENAKNFPQCVLEISDQEVLEWYTAKDFIVGKSLTILGRTFFIYDCDPFTRRYYKEKFGITDLPRIDVSKREPPPVKQELPPYNGFGLVEDSAQNCFALIPKAPKKDVIKMLVNDNKVLRYLAVLESPIPEDKDRRFVFSYFLATDMISIFEPPVRNSGIIGGKYLGRTKVVKPYSTVDNPVYYGPSDFFIGAVIEVFGHRFIILDTDEYVLKYMESNAAQYSPEALASIQNHVRKREAPAPEAESKQTEKDPGVQELEALIDTIQKQLKDHSCKDNIREAFQIYDKEASGYVDRDMFFKICESLNVPVDDSLVKELIRMCSHGEGKINYYNFVRAFSN

SEQ ID NO: 26734 - protein, 749 aa, Homo sapiens
  Payload ID: 5275
  Gene Symbol: EFHC2
  Gene Name: EF-hand domain (C-terminal) containing 2
  Uniprot ID: Q5JST6
  ENSP ID: ENSP00000404232
MALPLLPGNSFNRNVGKEKFHKSQHWGFCNNVMMLVSDEKPGIGGEPLLGQKIKPKCSIYPKGDGSDVPSWVAFDKQVLSFDAYLEEEVLDKSQTNYRIRYYKIYFYPEDDTIQVNEPEVKNSGLLQGTSIRRHRITLPPPDEDQFYTVYHFNVGTEVVFYGRTFKIYDCDAFTRNFLRKIGVKVNPPVQCPEDPYMKIRREVVEHVEPLRPYESLDTLKQFLQYHGKILCFFCLWDDSVSMFGDRRELILHYFLCDDTIEIKELLPHSSGRDALKMFLRRSKLPKNCPPRVYQPGQITDRAVLNSYGDFIKNQADGYLFDRYKLGKVDQEFYKDSDLSLGVTINVWGRKVLLYDCDEFTKSYYKSKYGIENFTSVSCKPPSPPPKIERKFPPYNGFGSEEDSLRNCIDLKPTPHRRNFKKFMEKDSYGSKSNILRFFAKLVTDKCVDLDRMFVISYYLGDDTISVFEPIERNSGIAGGMFLKRSRVKKPGQEVFKSELSEYIKAEELYIGVTVNVNGYLFRLLNADEYTLNYMEQNTDKYPFSNLKLALQKLKQEEGKSRELKQVFKAADSKHTNMVDYNTFRDILMSLTVGNLAEQEFVTIARHYRVPEGTCSDMDFLIALAHEKFKKNMFENFDTFIYSCVYEDREKKNVLPTKDIKRLCKSSRLPLSDDLLESLLSRFEDSEKQIDYKSFFSALNWRKNPVPELQPASYLKERCEDVWLGMPSPIPAKYIDYWTFLKDAFGLEEE

SEQ ID NO: 26735 - protein, 833 aa, Homo sapiens
  Payload ID: 5276
  Gene Symbol: EFHB
  Gene Name: EF-hand domain family, member B
  Uniprot ID: Q8N7U6
  ENSP ID: ENSP00000295824
MNMEIGHPHEGKDDLGDKRVIMGTKFPMELGIRVGLGKEDSRCGESPVVSNKCEGRMAPPETKFPLSKGLEMGLERQNISRTVMQRGSLGVDSVSASQGTKPSLLPGRMGLENESLLAGYTHERIIQPPLGRVCGSSQAAGSRRAPLASGPEGVEELVGKPAFVMEPRQEMEKESTCVLMKPNTEIKLPVEVDIGLTQAEGPDETKNTEPQMGLVIEPPQCQFAQQHEQRKEAGNIESGVEPPDRIRPIYSGKFFDRTPCWPSAGKVIPVGYRVATCLTEKLPRLITPPEAKKYFNFRYPPAGVERVFYGRANDPQIAPYLTHGIRSKISVLANTLINPQPITTFQQKIKDKKESIYLSNRRAPLGKSHDQAPGLPKGMDTTNTTFGTAVIKEYSAKDVVNPPKSYEEVFKEGNEGHDLYVVSHNDYYAGEAKNRKYNPSSFHRCSVYGVPTPHFNDGRAMAKSLYWLHELQMKRGAKFVSKRADDFKEKFQHKLGRVLDPIAETMNVPPDCTFGACLRPEEYGVGDLIHNRLPDEYLRGKDRQRALIAAVRHHLKKVNYQKFDTLLAAFRHYDKKGDGMIDKDELQEACDQANLSLDDKLLDQLFDYCDVDNDGFINYLEFANFLNWKDKMLLKEYEERVIIKGRKPDCVNPTEANVEEPEQTLLIKPEDIVLKEAGSTEKTLRTLLRPSDKVSNYYKTTSSEINAIVGAIPSTCYPICGVPTIRSDIPAPRIRRISDRTNYGEEGSAYSLLYPTIFARKGVFERDFFKTRSKEEIAEILCNIGVKLSDEEFENVWNLASKKHHRGEVCVENIRNVLDELRHADRIKCKTLM

SEQ ID NO: 26736 - protein, 703 aa, Homo sapiens
  Payload ID: 5276
  Gene Symbol: EFHB
  Gene Name: EF-hand domain family, member B
  Uniprot ID: Q8N7U6
  ENSP ID: ENSP00000342263
MMAHCRIDLLGSSDPPTSASQIAETTDVSHHAGLIEFLALSNSSALASRSVEITEIKLPVEVDIGLTQAEGPDETKNTEPQMGLVIEPPQCQFAQQHEQRKEAGNIESGVEPPDRIRPIYSGKFFDRTPCWPSAGKVIPVGYRVATCLTEKLPRLITPPEAKKYFNFRYPPAGVERVFYGRANDPQIAPYLTHGIRSKISVLANTLINPQPITTFQQKIKDKKESIYLSNRRAPLGKSHDQAPGLPKGMDTTNTTFGTAVIKEYSAKDVVNPPKSYEEVFKEGNEGHDLYVVSHNDYYAGEAKNRKYNPSSFHRCSVYGVPTPHFNDGRAMAKSLYWLHELQMKRGAKFVSKRADDFKEKFQHKLGRVLDPIAETMNVPPDCTFGACLRPEEYGVGDLIHNRLPDEYLRGKDRQRALIAAVRHHLKKVNYQKFDTLLAAFRHYDKKGDGMIDKDELQEACDQANLSLDDKLLDQLFDYCDVDNDGFINYLEFANFLNWKDKMLLKEYEERVIIKGRKPDCVNPTEANVEEPEQTLLIKPEDIVLKEAGSTEKTLRTLLRPSDKVSNYYKTTSSEINAIVGAIPSTCYPICGVPTIRSDIPAPRIRRISDRTNYGEEGSAYSLLYPTIFARKGVFERDFFKTRSKEEIAEILCNIGVKLSDEEFENVWNLASKKHHRGEVCVENIRNVLDELRHADRIKCKTLM

SEQ ID NO: 26737 - protein, 623 aa, Homo sapiens
  Payload ID: 5276
  Gene Symbol: EFHB
  Gene Name: EF-hand domain family, member B
  ENSP ID: ENSP00000373908
MNMEIGHPHEGKDDLGDKRVIMGTKFPMELGIRVGLGKEDSRCGESPVVSNKCEGRMAPPETKFPLSKGLEMGLERQNISRTVMQRGSLGVDSVSASQGTKPSLLPGRMGLENESLLAGYTHERIIQPPLGRVCGSSQAAGSRRAPLASGPEGVEELVGKPAFVMEPRQEMEKESTCVLMKPNTEIKLPVEVDIGLTQAEGPDETKNTEPQMGLVIEPPQCQFAQQHEQRKEAGNIESGVEPPDRIRPIYSGKFFDRTPCWPSAGKVIPVGYRVATCLTEKLPRLITPPEAKKYFNFRYPPAGVERVFYGRANDPQIAPYLTHGIRSKISVLANTLINPQPITTFQQKIKDKKESIYLSNRRAPLGKSHDQAPGLPKGMDTTNTTFGTAVIKEYSAKDVVNPPKSYEEVFKEGNEGHDLYVVSHNDYYAGEAKNRKYNPSSFHRCSVYGVPTPHFNDGRAMAKSLYWLHELQMKRGAKFVSKRADDFKEKFQHKLGRVLDPIAETMNVPPDCTFGACLRPEEYGVGDLIHNRLPDEYLRGKDRQRALIAAVRHHLKKVNYQKFDTLLAAFRHYDKASNGGELFGNAWAYRSQQFGVDQGSANYSLWAKSSPLFVCVSKVLLEH

SEQ ID NO: 26738 - protein, 260 aa, Homo sapiens
  Payload ID: 5276
  Gene Symbol: EFHB
  Gene Name: EF-hand domain family, member B
  ENSP ID: ENSP00000396778
PDRIRPIYSGKFFDRTPCWPSLITPPEAKKYFNFRYPPAGVERVFYGRANDPQIAPYLTHGIRSKISVLANTLINPQPITTFQQKIKDKKESIYLSNRRAPLGKSHDQAPGLPKGMDTTNTTFGTAVIKEYSAKDVVNPPKSYEEVFKEGNEGHDLYVVSHNDYYAGEAKNRKYNPSSFHRCSVYGVPTPHFNDGRAMAKSLYWLHELQMKRGAKFVSKRADDFKEKFQHKLGRVLDPIAETMNVPPDCTFGACLRPEEY

SEQ ID NO: 26739 - protein, 239 aa, Homo sapiens
  Payload ID: 5277
  Gene Symbol: EFHD1
  Gene Name: EF-hand domain family, member D1
  Uniprot ID: Q9BUP0
  ENSP ID: ENSP00000264059
MASEELACKLERRLRREEAEESGPQLAPLGAPAPEPKPEPEPPARAPTASADAELSAQLSRRLDINEGAARPRRCRVFNPYTEFPEFSRRLIKDLESMFKLYDAGRDGFIDLMELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 26740 - protein, 127 aa, Homo sapiens
  Payload ID: 5277
  Gene Symbol: EFHD1
  Gene Name: EF-hand domain family, member D1
  ENSP ID: ENSP00000386243
MELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 26741 - protein, 143 aa, Homo sapiens
  Payload ID: 5277
  Gene Symbol: EFHD1
  Gene Name: EF-hand domain family, member D1
  Uniprot ID: Q9BUP0
  ENSP ID: ENSP00000386556
MGELQYDAGRDGFIDLMELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 26742 - protein, 127 aa, Homo sapiens; identical to SEQ ID NO: 26740
  Payload ID: 5277
  Gene Symbol: EFHD1
  Gene Name: EF-hand domain family, member D1
  ENSP ID: ENSP00000386685

SEQ ID NO: 26743 - protein, 99 aa, Homo sapiens
  Payload ID: 5277
  Gene Symbol: EFHD1
  Gene Name: EF-hand domain family, member D1
  ENSP ID: ENSP00000395119
  MOD_RES (1)..(1): Any amino acid
XELACKLERRLRREEAEESGPQLAPLGAPAPEPKPEPEPPARAPTASADAELSAQLSRRLDINEGAARPRRCRVFNPYTEFPEFSRRLIKDLESMFKLI

SEQ ID NO: 26744 - protein, 81 aa, Homo sapiens
  Payload ID: 5277
  Gene Symbol: EFHD1
  Gene Name: EF-hand domain family, member D1
  ENSP ID: ENSP00000401073
MELKLMMEKLGAPQTHLGLKSMIKEVDEDFDGKLSFREFLLIFHKAAAGELQEDSGLMALAKLSEIDVALEGVKGAKNFFE

SEQ ID NO: 26745 - protein, 142 aa, Homo sapiens [sequence omitted]

SEQ ID NO: 26746 - protein, 240 aa, Homo sapiens
  Payload ID: 5278
  Gene Symbol: EFHD2
  Gene Name: EF-hand domain family, member D2
  Uniprot ID: Q96C19
  ENSP ID: ENSP00000365147
MATDELATKLSRRLQMEGEGGGETPEQPGLNGAAAAAAGAPDEAAEALGSADCELSAKLLRRADLNQGIGEPQSPSRRVFNPYTEFKEFSRKQIKDMEKMFKQYDAGRDGFIDLMELKLMMEKLGAPQTHLGLKNMIKEVDEDFDSKLSFREFLLIFRKAAAGELQEDSGLCVLARLSEIDVSSEGVKGAKSFFEAKVQAINVSSRFEEEIKAEQEERKKQAEEMKQRKAAFKELQSTFK

SEQ ID NO: 26747 - protein, 179 aa, Homo sapiens
  Payload ID: 5278
  Gene Symbol: EFHD2
  Gene Name: EF-hand domain family, member D2
  ENSP ID: ENSP00000395153
  MOD_RES (1)..(1): Any amino acid
XKMFKQYDAGRDGFIDLMELKLMMEKLGAPQTHLGLKNMIKEVDEDFDSKLSFREFLLIFRKAAAGELQEDSGLCVLARLSEIDVSSEGVKGAKSFFEAKWNWVCRWAPRTGSRGSGWQQLERLPSSALALQQPQNIGPGHQRVQPLRGGDQGRAGGKEEAGGGDEAAESGLQGAAVHL

SEQ ID NO: 26748 - protein, 821 aa, Homo sapiens
  Payload ID: 5279
  Gene Symbol: EFR3A
  Gene Name: EFR3 homolog A
  Uniprot ID: Q14156
  ENSP ID: ENSP00000254624
MPTRVCCCCSALRPRYKRLVDNIFPEDPKDGLVKTDMEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKNGQQLYRHIYLGCKEEDNVQKNYELLYTSLALITIELANEEVVIDLIRLAIALQDSAIINEDNLPMFHRCGIMALVAAYLNFVSQMIAVPAFCQHVSKVIEIRTMEAPYFLPEHIFRDKCMLPKSLEKHEKDLYFLTNKIAESLGGSGYSVERLSVPYVPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 26749 - protein, 785 aa, Homo sapiens
  Payload ID: 5279
  Gene Symbol: EFR3A
  Gene Name: EFR3 homolog A
  Uniprot ID: Q14156
  ENSP ID: ENSP00000428086
MEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKNGQQLYRHIYLGCKEEDNVQKNYELLYTSLALITIELANEEVVIDLIRLAIALQDSAIINEDNLPMFHRCGIMALVAAYLNFVSQMIAVPAFCQHVSKVIEIRTMEAPYFLPEHIFRDKCMLPKSLEKHEKDLYFLTNKIAESLGGSGYSVERLSVPYVPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 26750 - protein, 13 aa, Homo sapiens
  Payload ID: 5279
  Gene Symbol: EFR3A
  Gene Name: EFR3 homolog A
  ENSP ID: ENSP00000428844
MEKLTFYAVSAPE

SEQ ID NO: 26751 - protein, 133 aa, Homo sapiens
  Payload ID: 5279
  Gene Symbol: EFR3A
  Gene Name: EFR3 homolog A
  ENSP ID: ENSP00000430512
MEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGI

SEQ ID NO: 26752 - protein, 652 aa, Homo sapiens
  Payload ID: 5280
  Gene Symbol: EFR3B
  Gene Name: EFR3 homolog B
  ENSP ID: ENSP00000264719
FVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQVIETRKKEAPYMLPEDVFVERPRLSQNLDGVVIELLFRQSKISEVLGGSGYNSDRLCLPYIPQLTDEDRLSKRRSIGETISLQVEVESRNSPEKEERVPAEEITYETLKKAIVDSVAVEEQERERRRQVVEKFQKAPFEEIAAHCGARASLLQSKLNQIFEITIRPPPSPSGTITAAYGQPQNHSIPVYEMKFPDLCVY

SEQ ID NO: 26753 - protein, 817 aa, Homo sapiens
  Payload ID: 5280
  Gene Symbol: EFR3B
  Gene Name: EFR3 homolog B
  Uniprot ID: Q9Y2G0
  ENSP ID: ENSP00000384081
MYGVCGCCGALRPRYKRLVDNIFPEDPEDGLVKTNMEKLTFYALSAPEKLDRIGAYLSERLIRDVGRHRYGYVCIAMEALDQLLMACHCQSINLFVESFLKMVAKLLESEKPNLQILGTNSFVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEERVPAEEITYETLKKAIVDSVAVEEQERERRRQVVEKFQKAPFEEIAAHCGARASLLQSKLNQIFEITIRPPPSPSGTITAAYGQPQNHSIPVYEMKFPDLCVY

SEQ ID NO: 26754 - protein, 669 aa, Homo sapiens
  Payload ID: 5280
  Gene Symbol: EFR3B
  Gene Name: EFR3 homolog B
  Uniprot ID: Q9Y2G0
  ENSP ID: ENSP00000384454
MCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEERVPAEEITYETLKKAIVDSVAVEEQERERRRQVVEKFQKAPFEEIAAHCGARASLLQSKLNQIFEITIRPPPSPSGTITAAYGQPQNHSIPVYEMKFPDLCVY

SEQ ID NO: 26755 - protein, 782 aa, Homo sapiens
  Payload ID: 5280
  Gene Symbol: EFR3B
  Gene Name: EFR3 homolog B
  ENSP ID: ENSP00000385832
MEKLTFYALSAPEKLDRIGAYLSERLIRDVGRHRYGYVCIAMEALDQLLMACHCQSINLFVESFLKMVAKLLESEKPNLQILGTNSFVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEERVPAEEITYETLKKAIVDSVAVEEQERERRRQVVEKFQKAPFEEIAAHCGARASLLQSKLNQIFEITIRPPPSPSGTITAAYGQPQNHSIPVYEMKFPDLCVY

SEQ ID NO: 26756 - protein, 728 aa, Homo sapiens
  Payload ID: 5280
  Gene Symbol: EFR3B
  Gene Name: EFR3 homolog B
  Uniprot ID: Q9Y2G0
  ENSP ID: ENSP00000386082
MYGVCGCCGALRPRYKRLVDNIFPEDPEDGLVKTNMEKLTFYALSAPEKLDRIGAYLSERLIRDVGRHRYGYVCIAMEALDQLLMACHCQSINLFVESFLKMVAKLLESEKPNLQILGTNSFVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEEVSVRATVLGQPHLL

SEQ ID NO: 26757 - protein, 493 aa, Homo sapiens
  Payload ID: 5281
  Gene Symbol: EFEMP1
  Gene Name: EGF containing fibulin-like extracellular matrix protein 1
  Uniprot ID: Q12805
  ENSP ID: ENSP00000347596
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 26758 - protein, 493 aa, Homo sapiens; identical to SEQ ID NO: 26757
  Payload ID: 5281
  Gene Symbol: EFEMP1
  Gene Name: EGF containing fibulin-like extracellular matrix protein 1
  Uniprot ID: Q12805
  ENSP ID: ENSP00000378058

SEQ ID NO: 26759 - protein, 87 aa, Homo sapiens
  Payload ID: 5281
  Gene Symbol: EFEMP1
  Gene Name: EGF containing fibulin-like extracellular matrix protein 1
  ENSP ID: ENSP00000389319
MLKALFLTMLTLALVKSQDTEETITYTQCTDGYEWDPVRQQCKDIDECDIVPDACKGGMKCVNHYGGYLCLPKTAQIIVNNEQPQQE

SEQ ID NO: 26760 - protein, 172 aa, Homo sapiens
  Payload ID: 5281
  Gene Symbol: EFEMP1
  Gene Name: EGF containing fibulin-like extracellular matrix protein 1
  ENSP ID: ENSP00000392055
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQ

SEQ ID NO: 26761 - protein, 106 aa, Homo sapiens
  Payload ID: 5281
  Gene Symbol: EFEMP1
  Gene Name: EGF containing fibulin-like extracellular matrix protein 1
  ENSP ID: ENSP00000398345
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASS

SEQ ID NO: 26762 - protein, 27 aa, Homo sapiens
  Payload ID: 5281
  Gene Symbol: EFEMP1
  Gene Name: EGF containing fibulin-like extracellular matrix protein 1
  ENSP ID: ENSP00000398387
MLKALFLTMLTLALVKSQDTEETITYT

SEQ ID NO: 26763 - protein, 61 aa, Homo sapiens
  Payload ID: 5281
  Gene Symbol: EFEMP1
  Gene Name: EGF containing fibulin-like extracellular matrix protein 1
  ENSP ID: ENSP00000399480
MLKALFLTMLTLALVKSQDTEETITYTQCTDGYEWDPVRQQCKDIDECDIVPDACKGGMKC

SEQ ID NO: 26764 - protein, 51 aa, Homo sapiens
  Payload ID: 5281
  Gene Symbol: EFEMP1
  Gene Name: EGF containing fibulin-like extracellular matrix protein 1
  ENSP ID: ENSP00000405686
MLKALFLTMLTLALVKSQDTEETITYTQCTDGYEWDPVRQQCKDIDECDIV

SEQ ID NO: 26765 - protein, 119 aa, Homo sapiens
  Payload ID: 5281
  Gene Symbol: EFEMP1
  Gene Name: EGF containing fibulin-like extracellular matrix protein 1
  ENSP ID: ENSP00000408195
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFV

SEQ ID NO: 26766 - protein, 280 aa, Homo sapiens
  Payload ID: 5281
  Gene Symbol: EFEMP1
  Gene Name: EGF containing fibulin-like extracellular matrix protein 1
  ENSP ID: ENSP00000489183
  MOD_RES (1)..(1): Any amino acid
XNNFVIRRNPADPQRIPSNPSHRIQCAAGYEQSEHNVCQDIDECTAGTHNCRADQVCINLRGSFACQCPPGYQKRGEQCVDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 26767 - protein, 46 aa, Homo sapiens
  Payload ID: 5281
  Gene Symbol: EFEMP1
  Gene Name: EGF containing fibulin-like extracellular matrix protein 1
  ENSP ID: ENSP00000489578
MLKALFLTMLTLALVKSQDTEETITYTQCTDGYEWDPVRQQCKEDS

SEQ ID NO: 26768 - protein, 443 aa, Homo sapiens
  Payload ID: 5282
  Gene Symbol: EFEMP2
  Gene Name: EGF containing fibulin-like extracellular matrix protein 2
  Uniprot ID: O95967
  ENSP ID: ENSP00000309953
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGSFRCQCEPGFQLGPNNRSCVDVNECDMGAPCEQRCFNSYGTFLCRCHQGYELHRDGFSCSDIDECSYSSYLCQYRCINEPGRFSCHCPQGYQLLATRLCQDIDECESGAHQCSEAQTCVNFHGGYRCVDTNRCVEPYIQVSENRCLCPASNPLCREQPSSIVHRYMTITSERSVPADVFQIQATSVYPGAYNAFQIRAGNSQGDFYIRQINNVSAMLVLARPVTGPREYVLDLEMVTMNSLMSYRASSVLRLTVFVGAYTF

SEQ ID NO: 26769 - protein, 54 aa, Homo sapiens
  Payload ID: 5282
  Gene Symbol: EFEMP2
  Gene Name: EGF containing fibulin-like extracellular matrix protein 2
  ENSP ID: ENSP00000431305
  MOD_RES (1)..(1): Any amino acid
XQINNVSAMLVLARPVTGPREYVLDLEMVTMNSLMSYRASSVLRLTVFVGAYTF

SEQ ID NO: 26770 - protein, 69 aa, Homo sapiens
  Payload ID: 5282
  Gene Symbol: EFEMP2
  Gene Name: EGF containing fibulin-like extracellular matrix protein 2
  ENSP ID: ENSP00000432191
  MOD_RES (1)..(1): Any amino acid
XFQIRAGNSQGDFYIRQINNVSAMLVLARPVTGPREYVLDLEMVTMNSLMSYRASSVLRLTVFVGAYTF

SEQ ID NO: 26771 - protein, 436 aa, Homo sapiens
  Payload ID: 5282
  Gene Symbol: EFEMP2
  Gene Name: EGF containing fibulin-like extracellular matrix protein 2
  ENSP ID: ENSP00000434151
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGSFRCQCEPGFQLGPNNRSCVDVNECDMGAPCEQRCFNSYGTFLCRCHQGYELHRDGFSCSDIDECSYSSYLCQYRCINEPGRFSCHCPQGYQLLATRLCQDIDECESGAHQCSEAQTCVNFHGGYRCVDTNRCVEPYIQVSENRCLCPASNPLCREQPSSIVHRYMTITSERSVPADVFQIQATSVYPGAYNAFQIRAGNSQGDFYIRAQGPPLTGAGSSAPRASVTPRGEEVTRRADSRPRPRDLDLAGLQGS

SEQ ID NO: 26772 - protein, 443 aa, Homo sapiens; identical to SEQ ID NO: 26768
  Payload ID: 5282
  Gene Symbol: EFEMP2
  Gene Name: EGF containing fibulin-like extracellular matrix protein 2
  Uniprot ID: O95967
  ENSP ID: ENSP00000435295

SEQ ID NO: 26773 - protein, 202 aa, Homo sapiens
  Payload ID: 5282
  Gene Symbol: EFEMP2
  Gene Name: EGF containing fibulin-like extracellular matrix protein 2
  ENSP ID: ENSP00000435419
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGSFRCQCEPGFQLGPNNRSCV

SEQ ID NO: 26774 - protein, 77 aa, Homo sapiens
  Payload ID: 5282
  Gene Symbol: EFEMP2
  Gene Name: EGF containing fibulin-like extracellular matrix protein 2
  ENSP ID: ENSP00000435823
MLPCASCLPGSLLLWALLLLLLGSASPQDSEEPDSYTECTDGYEWDPDSQHCRGPAQETGCAQQAPLCRCQRVSDHP

SEQ ID NO: 26775 - protein, 183 aa, Homo sapiens
  Payload ID: 5282
  Gene Symbol: EFEMP2
  Gene Name: EGF containing fibulin-like extracellular matrix protein 2
  ENSP ID: ENSP00000435963
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGS

SEQ ID NO: 26776 - protein, 182 aa, Homo sapiens
  Payload ID: 5282
  Gene Symbol: EFEMP2
  Gene Name: EGF containing fibulin-like extracellular matrix protein 2
  ENSP ID: ENSP00000436521
DECESGAHQCSEAQTCVNFHGGYRCVDTNRCVEPYIQVSENRCLCPASNPLCREQPSSIVHRYMTITSERSVPADVFQIQATSVYPGAYNAFQIRAGNSQGDFYIRGPTPSEEQEGATLPAATLAEEPVVRGRMRKAQGPPLTGAGSSAPRASVTPRGEEVTRRADSRPRPRDLDLAGLQGS

SEQ ID NO: 26777 - protein, 76 aa, Homo sapiens
  Payload ID: 5282
  Gene Symbol: EFEMP2
  Gene Name: EGF containing fibulin-like extracellular matrix protein 2
  ENSP ID: ENSP00000436526
MTITSERSVPADVFQIQATSVYPGAYNAFQIRAGNSQGDFYIRQINNVSAMLVLARPVTGPREYVLDLEMVTMNSL

SEQ ID NO: 26778 - protein, 74 aa, Homo sapiens
  Payload ID: 5282
  Gene Symbol: EFEMP2
  Gene Name: EGF containing fibulin-like extracellular matrix protein 2
  ENSP ID: ENSP00000436536
SIVHRYMTITSERSVPADVFQIQATSVYPGAYNAFQIRAGNSQGDFYIRQINNVSAMLVLARPVTGPREPRGPH

SEQ ID NO: 26779 - protein, 58 aa, Homo sapiens
  Payload ID: 5282
  Gene Symbol: EFEMP2
  Gene Name: EGF containing fibulin-like extracellular matrix protein 2
  ENSP ID: ENSP00000437238
MLPCASCLPGSLLLWALLLLLLGSASPQDSEEPDSYTVGTVRAAGLGQEGCQRVSDHP

SEQ ID NO: 26780 - protein, 443 aa, Homo sapiens
  Payload ID: 5283
  Gene Symbol: EOGT
  Gene Name: EGF domain-specific O-linked N-acetylglucosamine (GlcNAc) transferase
  Uniprot ID: Q5NDL2
  ENSP ID: ENSP00000295571
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQSWFAELQSYTQLNFRPIEDAKCDIVIEKPTYFMKLDAGVNMYHHFCDFINLYITQHVNNSFSTDVYIVMWDTDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 26781 - protein, 527 aa, Homo sapiens
  Payload ID: 5283
  Gene Symbol: EOGT
  Gene Name: EGF domain-specific O-linked N-acetylglucosamine (GlcNAc) transferase
  Uniprot ID: Q5NDL2
  ENSP ID: ENSP00000373206
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQSWFAELQSYTQLNFRPIEDAKCDIVIEKPTYFMKLDAGVNMYHHFCDFINLYITQHVNNSFSTDVYIVMWDTSSYGYGDLFSDTWNAFTDYDVIHLKTYDSKRVCFKEAVFSLLPRMRYGLFYNTPLISGCQNTGLFRAFAQHVLHRLNITQEGPKDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 26782 - protein, 206 aa, Homo sapiens
  Payload ID: 5283
  Gene Symbol: EOGT
  Gene Name: EGF domain-specific O-linked N-acetylglucosamine (GlcNAc) transferase
  ENSP ID: ENSP00000384124
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQS

SEQ ID NO: 26783 - protein, 132 aa, Homo sapiens
  Payload ID: 5283
  Gene Symbol: EOGT
  Gene Name: EGF domain-specific O-linked N-acetylglucosamine (GlcNAc) transferase
  ENSP ID: ENSP00000408090
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMH

SEQ ID NO: 26784 - protein, 123 aa, Homo sapiens
  Payload ID: 5283
  Gene Symbol: EOGT
  Gene Name: EGF domain-specific O-linked N-acetylglucosamine (GlcNAc) transferase
  ENSP ID: ENSP00000411832
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGY

SEQ ID NO: 26785 - protein, 527 aa, Homo sapiens; identical to SEQ ID NO: 26781
  Payload ID: 5283
  Gene Symbol: EOGT
  Gene Name: EGF domain-specific O-linked N-acetylglucosamine (GlcNAc) transferase
  Uniprot ID: Q5NDL2
  ENSP ID: ENSP00000443780

SEQ ID NO: 26786 - protein, 443 aa, Homo sapiens; identical to SEQ ID NO: 26780
  Payload ID: 5283
  Gene Symbol: EOGT
  Gene Name: EGF domain-specific O-linked N-acetylglucosamine (GlcNAc) transferase
  Uniprot ID: Q5NDL2
  ENSP ID: ENSP00000444264

SEQ ID NO: 26787 - protein, 135 aa, Homo sapiens
  Payload ID: 5283
  Gene Symbol: EOGT
  Gene Name: EGF domain-specific O-linked N-acetylglucosamine (GlcNAc) transferase
  ENSP ID: ENSP00000480083
MISAHCNLCLLDSSDSCALASQVAGITGVHHHAQLIFVFLIETEFHHVGQAGLELWVQEILPPCLPKCWDYRCEPPRMALNFLFLGIPKFSTFSALEFVNIFVEYHMTVIPECSNLFMIYLGKFTTVLLFAIIWL

SEQ ID NO: 26788 - protein, 480 aa, Homo sapiens
  Payload ID: 5284
  Gene Symbol: EDIL3
  Gene Name: EGF-like repeats and discoidin I-like domains 3
  Uniprot ID: O43854
  ENSP ID: ENSP00000296591
MKRSVAVWLLVGLSLGVPQFGKGDICDPNPCENGGICLPGLADGSFSCECPDGFTDPNCSSVVEVASDEEEPTSAGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 26789 - protein, 470 aa, Homo sapiens
  Payload ID: 5284
  Gene Symbol: EDIL3
  Gene Name: EGF-like repeats and discoidin I-like domains 3
  Uniprot ID: O43854
  ENSP ID: ENSP00000369483
MKRSVAVWLLVGLSLGVPQFGKGDICDPNPCENGGICLPGLADGSFSCECPDGFTDPNCSSVVEVGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 26790 - protein, 1009 aa, Homo sapiens
  Payload ID: 5285
  Gene Symbol: EGFLAM
  Gene Name: EGF-like, fibronectin type III and laminin G domains
  Uniprot ID: Q63HQ2
  ENSP ID: ENSP00000313084
MDLIRGVLLRLLLLASSLGPGAVSLRAAIRKPGKVGPPLDIKLGALNCTAFSIQWKMPRHPGSPILGYTVFYSEVGADKSLQEQLHSVPLSRDIPTTEEVIGDLKPGTEYRVSIAAYSQAGKGRLSSPRHVTTLSQDSCLPPAAPQQPHVIVVSDSEVALSWKPGASEGSAPIQYYSVEFIRPDFDKKWTSIHERIQMDSMVIKGLDPDTNYQFAVRAMNSHGPSPRSWPSDIIRTLCPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 26791 - protein, 775 aa, Homo sapiens
  Payload ID: 5285
  Gene Symbol: EGFLAM
  Gene Name: EGF-like, fibronectin type III and laminin G domains
  Uniprot ID: Q63HQ2
  ENSP ID: ENSP00000337607
MHPGPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 26792 - protein, 1017 aa, Homo sapiens
  Payload ID: 5285
  Gene Symbol: EGFLAM
  Gene Name: EGF-like, fibronectin type III and laminin G domains
  Uniprot ID: Q63HQ2
  ENSP ID: ENSP00000346964
MDLIRGVLLRLLLLASSLGPGAVSLRAAIRKPGKVGPPLDIKLGALNCTAFSIQWKMPRHPGSPILGYTVFYSEVGADKSLQEQLHSVPLSRDIPTTEEVIGDLKPGTEYRVSIAAYSQAGKGRLSSPRHVTTLSQDSCLPPAAPQQPHVIVVSDSEVALSWKPGASEGSAPIQYYSVEFIRPDFDKKWTSIHERIQMDSMVIKGLDPDTNYQFAVRAMNSHGPSPRSWPSDIIRTLCPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKECGNYCLNTIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 26793 - protein, 375 aa, Homo sapiens
  Payload ID: 5285
  Gene Symbol: EGFLAM
  Gene Name: EGF-like, fibronectin type III and laminin G domains
  Uniprot ID: Q63HQ2
  ENSP ID: ENSP00000380385
MEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 26794 - protein, 152 aa, Homo sapiens
  Payload ID: 5285
  Gene Symbol: EGFLAM
  Gene Name: EGF-like, fibronectin type III and laminin G domains
  Uniprot ID: Q63HQ2
  ENSP ID: ENSP00000380393
MRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 26795 - protein, 152 aa, Homo sapiens; identical to SEQ ID NO: 26794
  Payload ID: 5285
  Gene Symbol: EGFLAM
  Gene Name: EGF-like, fibronectin type III and laminin G domains
  Uniprot ID: Q63HQ2
  ENSP ID: ENSP00000423228

SEQ ID NO: 26796 - protein, 152 aa, Homo sapiens; identical to SEQ ID NO: 26794
  Payload ID: 5285
  Gene Symbol: EGFLAM
  Gene Name: EGF-like, fibronectin type III and laminin G domains
  Uniprot ID: Q63HQ2
  ENSP ID: ENSP00000425579

SEQ ID NO: 26797 - protein, 47 aa, Homo sapiens
  Payload ID: 5285
  Gene Symbol: EGFLAM
  Gene Name: EGF-like, fibronectin type III and laminin G domains
  ENSP ID: ENSP00000426437
MDLIRGVLLRLLLLASSLGPGAVSLRAAIRKPGRCWRMTVTKTWTEP

SEQ ID NO: 26798 - protein, 112 aa, Homo sapiens
  Payload ID: 5285
  Gene Symbol: EGFLAM
  Gene Name: EGF-like, fibronectin type III and laminin G domains
  ENSP ID: ENSP00000427228
MRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTN

SEQ ID NO: 26799 - protein, 553 aa, Homo sapiens
  Payload ID: 5286
  Gene Symbol: EGFL6
  Gene Name: EGF-like-domain, multiple 6
  Uniprot ID: Q8IUX8
  ENSP ID: ENSP00000355126
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKDLNISVDCSFNHGICDWKQDREDDFDWNPADRDNAIGFYMAVPALAGHKKDIGRLKLLLPDLQPQSNFCLLFDYRLAGDKVGKLRVFVKNSNNALAWEKTTSEDEKWKTGKIQLYQGTDATKSIIFEAERGKGKTGEIAVDGVLLVSGLCPDSLLSVDD

SEQ ID NO: 26800 - protein, 554 aa, Homo sapiens
  Payload ID: 5286
  Gene Symbol: EGFL6
  Gene Name: EGF-like-domain, multiple 6
  Uniprot ID: Q8IUX8
  ENSP ID: ENSP00000369976
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKADLNISVDCSFNHGICDWKQDREDDFDWNPADRDNAIGFYMAVPALAGHKKDIGRLKLLLPDLQPQSNFCLLFDYRLAGDKVGKLRVFVKNSNNALAWEKTTSEDEKWKTGKIQLYQGTDATKSIIFEAERGKGKTGEIAVDGVLLVSGLCPDSLLSVDD

SEQ ID NO: 26801 - protein, 273 aa, Homo sapiens
  Payload ID: 5287
  Gene Symbol: EGFL7
  Gene Name: EGF-like-domain, multiple 7
  Uniprot ID: Q9UHF1
  ENSP ID: ENSP00000307843
MRGSQEVLLMWLLVLAVGGTEHAYRPGRRVCAVRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSDVDECSARRGGCPQRCVNTAGSYWCQCWEGHSLSADGTLCVPKGGPPRVAPNPTGVDSAMKEEVQRLQSRVDLLEEKLQLVLAPLHSLASQALEHGLPDPGSLLVHSFQQLGRIDSLSEQISFLEEQLGSCSCKKDS

SEQ ID NO: 26802 - protein, 273 aa, Homo sapiens; identical to SEQ ID NO: 26801
  Payload ID: 5287
  Gene Symbol: EGFL7
  Gene Name: EGF-like-domain, multiple 7
  Uniprot ID: Q9UHF1
  ENSP ID: ENSP00000360763

SEQ ID NO: 26803 - protein, 273 aa, Homo sapiens; identical to SEQ ID NO: 26801
  Payload ID: 5287
  Gene Symbol: EGFL7
  Gene Name: EGF-like-domain, multiple 7
  Uniprot ID: Q9UHF1
  ENSP ID: ENSP00000360764

SEQ ID NO: 26804 - protein, 273 aa, Homo sapiens; identical to SEQ ID NO: 26801
  Payload ID: 5287
  Gene Symbol: EGFL7
  Gene Name: EGF-like-domain, multiple 7
  Uniprot ID: Q9UHF1
  ENSP ID: ENSP00000385639

SEQ ID NO: 26805 - protein, 65 aa, Homo sapiens
  Payload ID: 5287
  Gene Symbol: EGFL7
  Gene Name: EGF-like-domain, multiple 7
  ENSP ID: ENSP00000473338
MRGSQEVLLMWLLVLAVGGTEHAYRPGRRVCAVRAHGDPVSESFVQRVYQPFLTTCDGHRACSTY

SEQ ID NO: 26806 - protein, 293 aa, Homo sapiens
  Payload ID: 5288
  Gene Symbol: EGFL8
  Gene Name: EGF-like-domain, multiple 8
  Uniprot ID: Q99944
  ENSP ID: ENSP00000333380
MGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVDVDECRTSITLCSHHCFNTAGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGACSCEDNSLGLGVNHR

SEQ ID NO: 26807 - protein, 293 aa, Homo sapiens; identical to SEQ ID NO: 26806
  Payload ID: 5288
  Gene Symbol: EGFL8
  Gene Name: EGF-like-domain, multiple 8
  Uniprot ID: Q99944
  ENSP ID: ENSP00000378888

SEQ ID NO: 26808 - protein, 293 aa, Homo sapiens [sequence omitted]

SEQ ID NO: 26809 - protein, 258 aa, Homo sapiens
  Payload ID: 5288
  Gene Symbol: EGFL8
  Gene Name: EGF-like-domain, multiple 8
  ENSP ID: ENSP00000387353
MGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGA

SEQ ID NO: 26810 - protein, 293 aa, Homo sapiens; identical to SEQ ID NO: 26806
  Payload ID: 5288
  Gene Symbol: EGFL8
  Gene Name: EGF-like-domain, multiple 8
  Uniprot ID: Q99944
  ENSP ID: ENSP00000388000

SEQ ID NO: 26811 - protein, 293 aa, Homo sapiens; identical to SEQ ID NO: 26806
  Payload ID: 5288
  Gene Symbol: EGFL8
  Gene Name: EGF-like-domain, multiple 8
  Uniprot ID: Q99944
  ENSP ID: ENSP00000390866

SEQ ID NO: 26812 - protein, 293 aa, Homo sapiens; identical to SEQ ID NO: 26806
  Payload ID: 5288
  Gene Symbol: EGFL8
  Gene Name: EGF-like-domain, multiple 8
  Uniprot ID: Q99944
  ENSP ID: ENSP00000394193

SEQ ID NO: 26813 - protein, 258 aa, Homo sapiens; identical to SEQ ID NO: 26809
  Payload ID: 5288
  Gene Symbol: EGFL8
  Gene Name: EGF-like-domain, multiple 8
  ENSP ID: ENSP00000394540

SEQ ID NO: 26814 - protein, 293 aa, Homo sapiens; identical to SEQ ID NO: 26806
  Payload ID: 5288
  Gene Symbol: EGFL8
  Gene Name: EGF-like-domain, multiple 8
  Uniprot ID: Q99944
  ENSP ID: ENSP00000397426

SEQ ID NO: 26815 - protein, 293 aa, Homo sapiens; identical to SEQ ID NO: 26806
  Payload ID: 5288
  Gene Symbol: EGFL8
  Gene Name: EGF-like-domain, multiple 8
  Uniprot ID: Q99944
  ENSP ID: ENSP00000398893

SEQ ID NO: 26816 - protein, 258 aa, Homo sapiens; identical to SEQ ID NO: 26809
  Payload ID: 5288
  Gene Symbol: EGFL8
  Gene Name: EGF-like-domain, multiple 8
  ENSP ID: ENSP00000401694

SEQ ID NO: 26817 - protein, 258 aa, Homo sapiens; identical to SEQ ID NO: 26809
  Payload ID: 5288
  Gene Symbol: EGFL8
  Gene Name: EGF-like-domain, multiple 8
  ENSP ID: ENSP00000403075

SEQ ID NO: 26818 - protein, 258 aa, Homo sapiens
  Payload ID: 5288
  Gene Symbol: EGFL8
  Gene Name: EGF-like-domain, multiple 8
  ENSP ID: ENSP00000404259
MGSRAELCTLLGGFSFLLLLIPGEGAKGGSLRESQGVCSKQTLVVPLHYNESYSQPVYKPYLTLCAGRRICSTYRTMYRVMWREVKREVQQTHAVCCQGWKKRHPGALTCEAICAKPCLNGGVCVRPDQCECAPGWGGKHCHVGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGA

SEQ ID NO: 26819 - protein, 258 aa, Homo sapiens; identical to SEQ ID NO: 26809
  Payload ID: 5288
  Gene Symbol: EGFL8
  Gene Name: EGF-like-domain, multiple 8
  ENSP ID: ENSP00000404308

SEQ ID NO: 26820 - protein, 293 aa, Homo sapiens; identical to SEQ ID NO: 26806
  Payload ID: 5288
  Gene Symbol: EGFL8
  Gene Name: EGF-like-domain, multiple 8
  Uniprot ID: Q99944
  ENSP ID: ENSP00000405502

SEQ ID NO: 26821 - protein, 293 aa, Homo sapiens [sequence omitted]

SEQ ID NO: 26822 - protein, 293 aa, Homo sapiens; identical to SEQ ID NO: 26806
  Payload ID: 5288
  Gene Symbol: EGFL8
  Gene Name: EGF-like-domain, multiple 8
  Uniprot ID: Q99944
  ENSP ID: ENSP00000411023

SEQ ID NO: 26823 - protein, 258 aa, Homo sapiens; identical to SEQ ID NO: 26809
  Payload ID: 5288
  Gene Symbol: EGFL8
  Gene Name: EGF-like-domain, multiple 8
  ENSP ID: ENSP00000413039

SEQ ID NO: 26824 - protein, 293 aa, Homo sapiens; identical to SEQ ID NO: 26806
  Payload ID: 5288
  Gene Symbol: EGFL8
  Gene Name: EGF-like-domain, multiple 8
  Uniprot ID: Q99944
  ENSP ID: ENSP00000414996

SEQ ID NO: 26825 - protein, 293 aa, Homo sapiens; identical to SEQ ID NO: 26806
  Payload ID: 5288
  Gene Symbol: EGFL8
  Gene Name: EGF-like-domain, multiple 8
  Uniprot ID: Q99944
  ENSP ID: ENSP00000415577

SEQ ID NO: 26826 - protein, 293 aa, Homo sapiens; identical to SEQ ID NO: 26806
  Payload ID: 5288
  Gene Symbol: EGFL8
  Gene Name: EGF-like-domain, multiple 8
  Uniprot ID: Q99944
  ENSP ID: ENSP00000416366

SEQ ID NO: 26827 - protein, 426 aa, Homo sapiens
  Payload ID: 5289
  Gene Symbol: EGLN1
  Gene Name: egl-9 family hypoxia-inducible factor 1
  Uniprot ID: Q9GZT9
  ENSP ID: ENSP00000355601
MANDSGGPGGPSPSERDRQYCELCGKMENLLRCSRCRSSFYCCKEHQRQDWKKHKLVCQGSEGALGHGVGPHQHSGPAPPAAVPPPRAGAREPRKAAARRDNASGDAAKGKVKAKPPADPAAAASPCRAAAGGQGSAVAAEAEPGKEEPPARSSLFQEKANLYPPSNTPGDALSPGGGLRPNGQTKPLPALKLALEYIVPCMNKHGICVVDDFLGKETGQQIGDEVRALHDTGKFTDGQLVSQKSDSSKDIRGDKITWIEGKEPGCETIGLLMSSMDDLIRHCNGKLGSYKINGRTKAMVACYPGNGTGYVRHVDNPNGDGRCVTCIYYLNKDWDAKVSGGILRIFPEGKAQFADIEPKFDRLLFFWSDRRNPHEVQPAYATRYAITVWYFDADERARAKVKYLTGEKGVRVELNKPSDSVGKDVF

SEQ ID NO: 26828 - protein, 407 aa, Homo sapiens
  Payload ID: 5290
  Gene Symbol: EGLN2
  Gene Name: egl-9 family hypoxia-inducible factor 2
  Uniprot ID: Q96KS0
  ENSP ID: ENSP00000307080
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAAQGARPEAPKRKWAEDGGDAPSPSKRPWARQENQEAEREGGMSCSCSSGSGEASAGLMEEALPSAPERLALDYIVPCMRYYGICVKDSFLGAALGGRVLAEVEALKRGGRLRDGQLVSQRAIPPRSIRGDQIAWVEGHEPGCRSIGALMAHVDAVIRHCAGRLGSYVINGRTKAMVACYPGNGLGYVRHVDNPHGDGRCITCIYYLNQNWDVKVHGGLLQIFPEGRPVVANIEPLFDRLLIFWSDRRNPHEVKPAYATRYAITVWYFDAKERAAAKDKYQLASGQKGVQVPVSQPPTPT

SEQ ID NO: 26829 - protein, 407 aa, Homo sapiens; identical to SEQ ID NO: 26828
  Payload ID: 5290
  Gene Symbol: EGLN2
  Gene Name: egl-9 family hypoxia-inducible factor 2
  Uniprot ID: Q96KS0
  ENSP ID: ENSP00000385253

SEQ ID NO: 26830 - protein, 77 aa, Homo sapiens
  Payload ID: 5290
  Gene Symbol: EGLN2
  Gene Name: egl-9 family hypoxia-inducible factor 2
  ENSP ID: ENSP00000469272
MDSPCQPQPLSQALPQLPGSSSEPLEPEPGRARMGVESYLPCPLLPSYHCPGVPSEASAGSGTPRATATSTTASPLR

SEQ ID NO: 26831 - protein, 94 aa, Homo sapiens
  Payload ID: 5290
  Gene Symbol: EGLN2
  Gene Name: egl-9 family hypoxia-inducible factor 2
  ENSP ID: ENSP00000469323
MDSPCQPQPLSQALPQLPGSSSEPLEPEPGRARMGVESYLPCPLLPSYHCPGVPSEASAGSGTPRATATSTTASPLRDGFGGQDGGELRPLQSE

SEQ ID NO: 26832 - protein, 407 aa, Homo sapiens; identical to SEQ ID NO: 26828
  Payload ID: 5290
  Gene Symbol: EGLN2
  Gene Name: egl-9 family hypoxia-inducible factor 2
  Uniprot ID: Q96KS0
  ENSP ID: ENSP00000469686

SEQ ID NO: 26833 - protein, 87 aa, Homo sapiens
  Payload ID: 5290
  Gene Symbol: EGLN2
  Gene Name: egl-9 family hypoxia-inducible factor 2
  ENSP ID: ENSP00000470968
MDSPCQPQPLSQALPQLPGSSSEPLEPEPGRARMGVESYLPCPLLPSYHCPGVPSEASAGSGTPRATATSTTASPLRDGFGGQDGGE

SEQ ID NO: 26834 - protein, 139 aa, Homo sapiens
  Payload ID: 5290
  Gene Symbol: EGLN2
  Gene Name: egl-9 family hypoxia-inducible factor 2
  ENSP ID: ENSP00000471546
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVTKGCQRLAAQGARPEAPKRKWAEDGGDAPSPSKRPWARQ

SEQ ID NO: 26835 - protein, 101 aa, Homo sapiens
  Payload ID: 5290
  Gene Symbol: EGLN2
  Gene Name: egl-9 family hypoxia-inducible factor 2
  ENSP ID: ENSP00000471568
MDSPCQPQPLSQALPQLPGSSSEPLEPEPGRARMGVESYLPCPLLPSYHCPGVPSEASAGSGTPRATATSTTASPLRDGFGGQDGGELRPLQSEGAAALVT

SEQ ID NO: 26836 - protein, 51 aa, Homo sapiens
  Payload ID: 5290
  Gene Symbol: EGLN2
  Gene Name: egl-9 family hypoxia-inducible factor 2
  ENSP ID: ENSP00000471740
PHEVKPAYATRYAITVWYFDAKERAAAKDKYQLASGQKGVQVPVSQPPTPT

SEQ ID NO: 26837 - protein, 96 aa, Homo sapiens
  Payload ID: 5290
  Gene Symbol: EGLN2
  Gene Name: egl-9 family hypoxia-inducible factor 2
  ENSP ID: ENSP00000471944
  MOD_RES (1)..(1): Any amino acid
XGGLLQIFPEGRPVVANIEPLFDRLLIFWSDRRNPHEVKPAYATRYAITVWYFDAKERAAAKDKYQLGTCFPPFSPSYSVGPLGPDATPSPSSASC

SEQ ID NO: 26838 - protein, 72 aa, Homo sapiens
  Payload ID: 5290
  Gene Symbol: EGLN2
  Gene Name: egl-9 family hypoxia-inducible factor 2
  ENSP ID: ENSP00000472146
MDSPCQPQPLSQALPQLPGSSSEPLEPEPGRARMGVESYLPCPLLPSYHCPGVPSEASAGSGTPRATATSTT

SEQ ID NO: 26839 - protein, 125 aa, Homo sapiens
  Payload ID: 5290
  Gene Symbol: EGLN2
  Gene Name: egl-9 family hypoxia-inducible factor 2
  ENSP ID: ENSP00000472414
MVACYPGNGLGYVRHVDNPHGDGRCITCIYYLNQNWDVKVHGGLLQIFPEGRPVVANIEPLFDRLLIFWSDRRNPHEVKPAYATRYAITVWYFDAKERAAAKDKYQLASGQKGVQVPVSQPPTPT

SEQ ID NO: 26840 - protein, 67 aa, Homo sapiens
  Payload ID: 5290
  Gene Symbol: EGLN2
  Gene Name: egl-9 family hypoxia-inducible factor 2
  ENSP ID: ENSP00000472870
MDSPCQPQPLSQALPQLPGSSSEPLEPEPGRARMGVESYLPCPLLPSYHCPGVPSEASAGSGTPRAT

SEQ ID NO: 26841 - protein, 128 aa, Homo sapiens
  Payload ID: 5290
  Gene Symbol: EGLN2
  Gene Name: egl-9 family hypoxia-inducible factor 2
  ENSP ID: ENSP00000472991
IAWVEGHEPGCRSIGALMAHVDAVIRHCAGRLGSYVINGRTKVHGGLLQIFPEGRPVVANIEPLFDRLLIFWSDRRNPHEVKPAYATRYAITVWYFDAKERAAAKDKYQLASGQKGVQVPVSQPPTPT

SEQ ID NO: 26842 - protein, 239 aa, Homo sapiens
  Payload ID: 5291
  Gene Symbol: EGLN3
  Gene Name: egl-9 family hypoxia-inducible factor 3
  Uniprot ID: Q9H6Z9
  ENSP ID: ENSP00000250457
MPLGHIMRLDLEKIALEYIVPCLHEVGFCYLDNFLGEVVGDCVLERVKQLHCTGALRDGQLAGPRAGVSKRHLRGDQITWIGGNEEGCEAISFLLSLIDRLVLYCGSRLGKYYVKERSKAMVACYPGNGTGYVRHVDNPNGDGRCITCIYYLNKNWDAKLHGGILRIFPEGKSFIADVEPIFDRLLFFWSDRRNPHEVQPSYATRYAMTVWYFDAEERAEAKKKFRNLTRKTESALTED

SEQ ID NO: 26843 - protein, 148 aa, Homo sapiens
  Payload ID: 5291
  Gene Symbol: EGLN3
  Gene Name: egl-9 family hypoxia-inducible factor 3
  ENSP ID: ENSP00000446572
MPLGHIMRLDLEKIALEYIVPCLHEVGFCYLDNFLGEVVGDCVLERVKQLHCTGALRDGQLAGPRAGVSKRHLRGDQITWIGGNEEGCEAISFLLSLIDRLVLYCGSRLGKYYVKERSKVGRARRPAAAAPAGTGGTRSPLYVDFPGP

SEQ ID NO: 26844 - protein, 145 aa, Homo sapiens
  Payload ID: 5291
  Gene Symbol: EGLN3
  Gene Name: egl-9 family hypoxia-inducible factor 3
  ENSP ID: ENSP00000447470
MPLGHIMRLDLEKIALEYIVPCLHEAMVACYPGNGTGYVRHVDNPNGDGRCITCIYYLNKNWDAKLHGGILRIFPEGKSFIADVEPIFDRLLFFWSDRRNPHEVQPSYATRYAMTVWYFDAEERAEAKKKFRNLTRKTESALTED

SEQ ID NO: 26845 - protein, 79 aa, Homo sapiens
  Payload ID: 5291
  Gene Symbol: EGLN3
  Gene Name: egl-9 family hypoxia-inducible factor 3
  ENSP ID: ENSP00000451316
MAMVACYPGNGTGYVRHVDNPNGDGRCITCIYYLNKNWDAKLHGGILRIFPEGKSFIADVEPIFDRLLFFWSDRRNPHE

SEQ ID NO: 26846 - protein, 1231 aa, Homo sapiens
  Payload ID: 5292
  Gene Symbol: EHBP1
  Gene Name: EH domain binding protein 1
  Uniprot ID: Q8NDI1
  ENSP ID: ENSP00000263991
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITEIVNQLNALSSLDEDQDDCIKQANMRSAKSASSSEELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGDENDNIEIDTNEEIPEGFVVGGGDELTNLENDLDTPEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 26847 - protein, 1160 aa, Homo sapiens
  Payload ID: 5292
  Gene Symbol: EHBP1
  Gene Name: EH domain binding protein 1
  Uniprot ID: Q8NDI1
  ENSP ID: ENSP00000384143
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 26848 - protein, 310 aa, Homo sapiens
  Payload ID: 5292
  Gene Symbol: EHBP1
  Gene Name: EH domain binding protein 1
  ENSP ID: ENSP00000384829
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNI

SEQ ID NO: 26849 - protein, 1196 aa, Homo sapiens
  Payload ID: 5292
  Gene Symbol: EHBP1
  Gene Name: EH domain binding protein 1
  Uniprot ID: Q8NDI1
  ENSP ID: ENSP00000385524
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGDENDNIEIDTNEEIPEGFVVGGGDELTNLENDLDTPEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 26850 - protein, 223 aa, Homo sapiens
  Payload ID: 5292
  Gene Symbol: EHBP1
  Gene Name: EH domain binding protein 1
  ENSP ID: ENSP00000388442
  MOD_RES (1)..(1): Any amino acid
XNTNTATPFCNRQLSDQDEERRRQLRERARQLIAEARSGVKMSELPSYGEMAAEKLKERSKASGDENDNIEIDTNEEIPEGFVVGGGDELTNLENDLDTPEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVL

SEQ ID NO: 26851 - protein, 108 aa, Homo sapiens
  Payload ID: 5292
  Gene Symbol: EHBP1
  Gene Name: EH domain binding protein 1
  ENSP ID: ENSP00000392192
MNWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKP

SEQ ID NO: 26852 - protein, 41 aa, Homo sapiens
  Payload ID: 5292
  Gene Symbol: EHBP1
  Gene Name: EH domain binding protein 1
  ENSP ID: ENSP00000392441
MKQYASPMPTQTDVKLKFKPLSKKVVSAALQFSLSCIFLRE

SEQ ID NO: 26853 - protein, 110 aa, Homo sapiens
  Payload ID: 5292
  Gene Symbol: EHBP1
  Gene Name: EH domain binding protein 1
  ENSP ID: ENSP00000396186
  MOD_RES (1)..(1): Any amino acid
XLEKEKLENSRSLECRSDPESPIKKTSLSPTSKLGYSYSRDLDLAKKKHASLRQTESDPDADRTTLNHADHSSKIVQQQDEERRRQLRERARQLIAEARSGVKMSELPSY

SEQ ID NO: 26854 - protein, 95 aa, Homo sapiens
  Payload ID: 5292
  Gene Symbol: EHBP1
  Gene Name: EH domain binding protein 1
  ENSP ID: ENSP00000399609
MKQYASPMPTQTDVKLKFKPLSKKVVSAALQFSLSCIFLREGKATDEDMQSLASLMSMKQADIGNLDDFEEDNEDDDENRVNQEEKAAKITEIVN

SEQ ID NO: 26855 - protein, 154 aa, Homo sapiens
  Payload ID: 5292
  Gene Symbol: EHBP1
  Gene Name: EH domain binding protein 1
  ENSP ID: ENSP00000399927
  MOD_RES (1)..(1): Any amino acid
XRLLEPSDMTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGDENDNIEIDTNEEIPEGFVVGGGDE

SEQ ID NO: 26856 - protein, 1160 aa, Homo sapiens; identical to SEQ ID NO: 26847
  Payload ID: 5292
  Gene Symbol: EHBP1
  Gene Name: EH domain binding protein 1
  Uniprot ID: Q8NDI1
  ENSP ID: ENSP00000403783

SEQ ID NO: 26857 - protein, 77 aa, Homo sapiens
  Payload ID: 5292
  Gene Symbol: EHBP1
  Gene Name: EH domain binding protein 1
  ENSP ID: ENSP00000404617
MASVWKRLQRVGKHASKFQFVASYQELMVECTKKWQPDKLVVVWTRRSRRKSSKAHSWQPGIKNPYRGVVVWPVPEN

SEQ ID NO: 26858 - protein, 1523 aa, Homo sapiens
  Payload ID: 5293
  Gene Symbol: EHBP1L1
  Gene Name: EH domain binding protein 1-like 1
  Uniprot ID: Q8N3D4
  ENSP ID: ENSP00000312671
MTSVWKRLQRVGKRAAKFQFVACYHELVLECTKKWQPDKLVVVWTRRNRRICSKAHSWQPGIQNPYRGTVVWMVPENVDISVTLYRDPHVDQYEAKEWTFIIENESKGQRKVLATAEVDLARHAGPVPVQVPVRLRLKPKSVKVVQAELSLTLSGVLLREGRATDDDMQSLASLMSVKPSDVGNLDDFAESDEDEAHGPGAPEARARVPQPDPSRELKTLCEEEEEGQGRPQQAVASPSNAEDTSPAPVSAPAPPARTSRGQGSERANEAGGQVGPEAPRPPETSPEMRSSRQPAQDTAPTPAPRLRKGSDALRPPVPQGEDEVPKASGAPPAGLGSARETQAQACPQEGTEAHGARLGPSIEDKGSGDPFGRQRLKAEEMDTEDRPEASGVDTEPRSGGREANTKRSGVRAGEAEESSAVCQVDAEQRSKVRHVDTKGPEATGVMPEARCRGTPEAPPRGSQGRLGVRTRDEAPSGLSLPPAEPAGHSGQLGDLEGARAAAGQEREGAEVRGGAPGIEGTGLEQGPSVGAISTRPQVSSWQGALLSTAQGAISRGLGGWEAEAGGSGDLETETEVVGLEVLGTQEKEVEGSGFPETRTLEIEILGALEKEAARSRVLESEVAGTAQCEGLETQETEVGVIETPGTETEVLGTQKTEAGGSGVLQTRTTIAETEVLVTQEISGDLGPLKIEDTIQSEMLGTQETEVEASRVPESEAEGTEAKILGTQEITARDSGVREIEAEIAESDILVAQEIEVGLLGVLGIETGAAEGAILGTQEIASRDSGVPGLEADTTGIQVKEVGGSEVPEIATGTAETEILGTQEIASRSSGVPGLESEVAGAQETEVGGSGISGPEAGMAEARVLMTRKTEIIVPEAEKEEAQTSGVQEAETRVGSALKYEALRAPVTQPRVLGSQEAKAEISGVQGSETQVLRVQEAEAGVWGMSEGKSGAWGAQEAEMKVLESPENKSGTFKAQEAEAGVLGNEKGKEAEGSLTEASLPEAQVASGAGAGAPRASSPEKAEEDRRLPGSQAPPALVSSSQSLLEWCQEVTTGYRGVRITNFTTSWRNGLAFCAILHRFYPDKIDYASLDPLNIKQNNKQAFDGFAALGVSRLLEPADMVLLSVPDKLIVMTYLCQIRAFCTGQELQLVQLEGGGGAGTYRVGSAQPSPPDDLDAGGLAQRLRGHGAEGPQEPKEAADRADGAAPGVASRNAVAGRASKDGGAEAPRESRPAEVPAEGLVNGAGAPGGGGVRLRRPSVNGEPGSVPPPRAHGSFSHVRDADLLKKRRSRLRNSSSFSMDDPDAGAMGAAAAEGQAPDPSPAPGPPTAADSQQPPGGSSPSEEPPPSPGEEAGLQRFQDTSQYVCAELQALEQEQRQIDGRAAEVEMQLRSLMESGANKLQEEVLIQEWFTLVNKKNALIRRQDQLQLLMEEQDLERRFELLSRELRAMLAIEDWQKTSAQQHREQLLLEELVSLVNQRDELVRDLDHKERIALEEDERLERGLEQRRRKLSRQLSRRERCVLS

SEQ ID NO: 26859 - protein, 670 aa, Homo sapiens
  Payload ID: 5293
  Gene Symbol: EHBP1L1
  Gene Name: EH domain binding protein 1-like 1
  ENSP ID: ENSP00000431996
MTSVWKRLQRVGKRAAKFQFVACYHELVLECTKKWQPDKLVVVWTRRNRRICSKAHSWQPGIQNPYRGTVVWMVPENVDISVTLYRDPHVDQYEAKEWTFIIENESKGQRKVLATAEVDLARHAGPVPVQVPVRLRLKPKSVKVVQAELSLTLSGVLLREGRATDDDMQSLASLMSVKPSDVGNLDDFAESDEDEAHGPGAPEARARVPQPDPSRELKTLCEEEEEGQGRPQQAVASPSNAEDTSPAPVSAPAPPARTSRGQGSERANEAGGQVGPEAPRPPETSPEMRSSRQPAQDTAPTPAPRLRKGSDALRPPVPQGEDEVPKASGAPPAGLGSARETQAQACPQEGTEAHGARLGPSIEDKGSGDPFGRQRLKAEEMDTEDRPEASGVDTEPRSGGREANTKRSGVRAGEAEESSAVCQVDAEQRSKVRHVDTKGPEATGVMPEAPPALVSSSQSLLEWCQEVTTGYRGVRITNFTTSWRNGLAFCAILHRFYPDKIDYASLDPLNIKQNNKQAFDGFAALGVSRLLEPADMVLLSVPDKLIVMTYLCQIRAFCTGQELQLVQLEGGGGAGTYRVGSAQPSPPDDLDAGGLAQRLRGHGAEGPQEPKEAADRADGAAPGVASRNAVAGRASKDGGAEAPRESRPAEVPAEGLVNGAGAPGGGGVRL

SEQ ID NO: 26860 - protein, 265 aa, Homo sapiens
  Payload ID: 5293
  Gene Symbol: EHBP1L1
  Gene Name: EH domain binding protein 1-like 1
  ENSP ID: ENSP00000434693
  MOD_RES (1)..(1): Any amino acid
XVRAGEAEESSAVCQVDAEQRSKAQEAEAGVLGNEKGKEAEGSLTEASLPEAQVASGAGAGAPRASSPEKAEEDRRLPGSQAPPALVSSSQSLLEWCQEVTTGYRGVRITNFTTSWRNGLAFCAILHRFYPDKIDYASLDPLNIKQNNKQAFDGFAALGVSRLLEPADMVLLSVPDKLIVMTYLCQIRAFCTGQELQLVQLEGGGGAGTYRVGSAQPSPPDDLDAGGLAQRLRGHGAEGPQEPKEAADRADGAAPGVASRNAVAG

SEQ ID NO: 26861 - protein, 467 aa, Homo sapiens
  Payload ID: 5293
  Gene Symbol: EHBP1L1
  Gene Name: EH domain binding protein 1-like 1
  ENSP ID: ENSP00000489002
MTSVWKRLQRVGKRAAKFQFVACYHELVLECTKKWQPDKLVVVWTRRNRRICSKAHSWQPGIQNPYRGTVVWMVPENVDISVTLYRDPHVDQYEAKEWTFIIENESKGQRKVLATAEVDLARHAGPVPVQVPVRLRLKPKSVKVVQAELSLTLSGVLLREGRATDDDMQSLASLMSVKPSDVGNLDDFAESDEDEAHGPGAPEARARVPQPGRGGALRPGRFPDPSRELKTLCEEEEEGQGRPQQAVASPSNAEDTSPAPAPPALVSSSQSLLEWCQEVTTGYRGVRITNFTTSWRNGLAFCAILHRFYPDKIDYASLDPLNIKQNNKQAFDGFAALGVSRLLEPADMVLLSVPDKLIVMTYLCQIRAFCTGQELQLVQLEGGGGAGTYRVGSAQPSPPDDLDAGGLAQRLRGHGAEGPQEPKEAADRADGAAPGVASRNAVAGRASKDGGAEAPRESRPAEVPAEG

SEQ ID NO: 26862 - protein, 534 aa, Homo sapiens
  Payload ID: 5294
  Gene Symbol: EHD1
  Gene Name: EH-domain containing 1
  Uniprot ID: Q9H4M9
  ENSP ID: ENSP00000320516
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVGKDKPTYDEIFYTLSPVNGKITGANAKKEMVKSKLPNTVLGKIWKLADVDKDGLLDDEEFALANHLIKVKLEGHELPADLPPHLVPPSKRRHE

SEQ ID NO: 26863 - protein, 534 aa, Homo sapiens; identical to SEQ ID NO: 26862
  Payload ID: 5294
  Gene Symbol: EHD1
  Gene Name: EH-domain containing 1
  Uniprot ID: Q9H4M9
  ENSP ID: ENSP00000352354

SEQ ID NO: 26864 - protein, 306 aa, Homo sapiens
  Payload ID: 5294
  Gene Symbol: EHD1
  Gene Name: EH-domain containing 1
  ENSP ID: ENSP00000391429
MCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVG

SEQ ID NO: 26865 - protein, 162 aa, Homo sapiens
  Payload ID: 5294
  Gene Symbol: EHD1
  Gene Name: EH-domain containing 1
  ENSP ID: ENSP00000396273
MCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLI

SEQ ID NO: 26866 - protein, 148 aa, Homo sapiens
  Payload ID: 5294
  Gene Symbol: EHD1
  Gene Name: EH-domain containing 1
  ENSP ID: ENSP00000399022
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDS

SEQ ID NO: 26867 - protein, 145 aa, Homo sapiens
  Payload ID: 5294
  Gene Symbol: EHD1
  Gene Name: EH-domain containing 1
  ENSP ID: ENSP00000403830
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPV

SEQ ID NO: 26868 - protein, 374 aa, Homo sapiens
  Payload ID: 5294
  Gene Symbol: EHD1
  Gene Name: EH-domain containing 1
  ENSP ID: ENSP00000404944
MEQPGTAASPVSGSMFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQ

SEQ ID NO: 26869 - protein, 548 aa, Homo sapiens
  Payload ID: 5294
  Gene Symbol: EHD1
  Gene Name: EH-domain containing 1
  ENSP ID: ENSP00000479153
MEQPGTAASPVSGSMFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVGKDKPTYDEIFYTLSPVNGKITGANAKKEMVKSKLPNTVLGKIWKLADVDKDGLLDDEEFALANHLIKVKLEGHELPADLPPHLVPPSKRRHE

SEQ ID NO: 26870 - protein, 543 aa, Homo sapiens
  Payload ID: 5295
  Gene Symbol: EHD2
  Gene Name: EH-domain containing 2
  Uniprot ID: Q9NZN4
  ENSP ID: ENSP00000263277
MFSWLKRGGARGQQPEAIRTVTSALKELYRTKLLPLEEHYRFGAFHSPALEDADFDGKPMVLVAGQYSTGKTSFIQYLLEQEVPGSRVGPEPTTDCFVAVMHGDTEGTVPGNALVVDPDKPFRKLNPFGNTFLNRFMCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRVHAYIISYLKKEMPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDGMLDDEEFALASHLIEAKLEGHGLPANLPRRLVPPSKRRHKGSAE

SEQ ID NO: 26871 - protein, 407 aa, Homo sapiens
  Payload ID: 5295
  Gene Symbol: EHD2
  Gene Name: EH-domain containing 2
  Uniprot ID: Q9NZN4
  ENSP ID: ENSP00000439036
MCAQLPNQVLESISIIDTPGILSGAKQRVSRGYDFPAVLRWFAERVDLIILLFDAHKLEISDEFSEAIGALRGHEDKIRVVLNKADMVETQQLMRVYGALMWALGKVVGTPEVLRVYIGSFWSQPLLVPDNRRLFELEEQDLFRDIQGLPRHAALRKLNDLVKRARLVRVHAYIISYLKKEMPSVFGKENKKKQLILKLPVIFAKIQLEHHISPGDFPDCQKMQELLMAHDFTKFHSLKPKLLEALDEMLTHDIAKLMPLLRQEELESTEVGVQGGAFEGTHMGPFVERGPDEAMEDGEEGSDDEAEWVVTKDKSKYDEIFYNLAPADGKLSGSKAKTWMVGTKLPNSVLGRIWKLSDVDRDGMLDDEEFALASHLIEAKLEGHGLPANLPRRLVPPSKRRHKGSAE

SEQ ID NO: 26872 - protein, 30 aa, Homo sapiens
  Payload ID: 5295
  Gene Symbol: EHD2
  Gene Name: EH-domain containing 2
  ENSP ID: ENSP00000471766
KRARLVRVSSPEGWARILGGGFLGPLLPVL

SEQ ID NO: 26873 - protein, 535 aa, Homo sapiens
  Payload ID: 5296
  Gene Symbol: EHD3
  Gene Name: EH-domain containing 3
  Uniprot ID: Q9NZN3
  ENSP ID: ENSP00000327116
MFSWLGTDDRRRKDPEVFQTVSEGLKKLYKSKLLPLEEHYRFHEFHSPALEDADFDNKPMVLLVGQYSTGKTTFIRYLLEQDFPGMRIGPEPTTDSFIAVMQGDMEGIIPGNALVVDPKKPFRKLNAFGNAFLNRFVCAQLPNPVLESISVIDTPGILSGEKQRISRGYDFAAVLEWFAERVDRIILLFDAHKLDISDEFSEVIKALKNHEDKMRVVLNKADQIETQQLMRVYGALMWSLGKIVNTPEVIRVYIGSFWSHPLLIPDNRKLFEAEEQDLFRDIQSLPRNAALRKLNDLIKRARLAKVHAYIISSLKKEMPSVFGKDNKKKELVNNLAEIYGRIEREHQISPGDFPNLKRMQDQLQAQDFSKFQPLKSKLLEVVDDMLAHDIAQLMVLVRQEESQRPIQMVKGGAFEGTLHGPFGHGYGEGAGEGIDDAEWVVARDKPMYDEIFYTLSPVDGKITGANAKKEMVRSKLPNSVLGKIWKLADIDKDGMLDDDEFALANHLIKVKLEGHELPNELPAHLLPPSKRKVAE

SEQ ID NO: 26874 - protein, 546 aa, Homo sapiens
  Payload ID: 5296
  Gene Symbol: EHD3
  Gene Name: EH-domain containing 3
  ENSP ID: ENSP00000440685
MFSWLGTDDRRRKDPEVFQTVSEGLKKLYKSKLLPLEEHYRFHEFHSPALEDADFDNKPMVLLVGQYSTGKTTFIRYLLEQDFPGMRIGPEPTTDSFIAVMQGDMEGIIPGNALVVDPKKPFRKLNAFGNAFLNRFVCAQLPNPVLESISVIDTPGILSGEKQRISRGYDFAAVLEWFAERVDRIILLFDAHKLDISDEFSEVIKALKNHEDKMRVVLNKADQIETQQLMRVYGALMWSLGKIVNTPEVIRVYIGSFWSHPLLIPDNRKLFEAEEQDLFRDIQSLPRNAALRKLNDLIKRARLAKVHAYIISSLKKEMPSVFGKDNKKKELVNNLAEIYGRIEREHQISPGDFPNLKRMQDQLQAQDFSKFQPLKSKLLEVVDDMLAHDIAQLMVLVRQEESQRPIQMVKGGAFEGTLHGPFGHGYGEGAGEGIDDAEWVVARDKPMYDEIFYTLSPVDGKITGANAKKEMVRSKLPNSVLGKIWKLADIDKDGMLDDDEFALANHLIKVKLEGHELPNELPAHLLPRPRGKLPSDGVGGHSDGQC

SEQ ID NO: 26875 - protein, 541 aa, Homo sapiens
  Payload ID: 5297
  Gene Symbol: EHD4
  Gene Name: EH-domain containing 4
  Uniprot ID: Q9H223
  ENSP ID: ENSP00000220325
MFSWMGRQAGGRERAGGADAVQTVTGGLRSLYLRKVLPLEEAYRFHEFHSPALEDADFENKPMILLVGQYSTGKTTFIRYLLEQDFPGMRIGPEPTTDSFIAVMYGETEGSTPGNALVVDPKKPFRKLSRFGNAFLNRFMCSQLPNQVLKSISVIDSPGILSGEKQRISRGYDFCQVLQWFAERVDRIILLFDAHKLDISDEFSEAIKAFRGQDDKIRVVLNKADQVDTQQLMRVYGALMWSLGKVINTPEVLRVYIGSFWAQPLQNTDNRRLFEAEAQDLFRDIQSLPQKAAVRKLNDLIKRARLAKVHAYIISYLKKEMPSVFGKENKKRELISRLPEIYIQLQREYQISAGDFPEVKAMQEQLENYDFTKFHSLKPKLIEAVDNMLSNKISPLMNLISQEETSTPTQLVQGGAFDGTTEGPFNQGYGEGAKEGADEEEWVVAKDKPVYDELFYTLSPINGKISGVNAKKEMVTSKLPNSVLGKIWKLADCDCDGMLDEEEFALAKHLIKIKLDGYELPSSLPPHLVPPSHRKSLPKAD

SEQ ID NO: 26876 - protein, 540 aa, Homo sapiens
  Payload ID: 5297
  Gene Symbol: EHD4
  Gene Name: EH-domain containing 4
  ENSP ID: ENSP00000478504
MFSWMGRQAGGRERAGGADAVQTVTGGLRSLYLRKVLPLEEAYRFHEFHSPALEDADFENKPMILLVGQYSTGKTTFIRYLLEQDFPGMRIGPEPTTDSFIAVMYGETEGSTPGNALVVDPKKPFRKLSRFGNAFLNRFMCSQLPNQVLKSISVIDSPGILSGEKQRISRGYDFCQVLQWFAERVDRIILLFDAHKLDISDEFSEAIKAFRGQDDKIRVVLNKADQVDTQQLMRVYGALMWSLGKVINTPEVLRVYIGSFWAQPLQNTDNRRLFEAEAQDLFRDIQSLPQKAAVRKLNDLIKRARLAKVHAYIISYLKKEMPSVFGKENKKRELISRLPEIYIQLQREYQISAGDFPEVKAMQEQLENYDFTKFHSLKPKLIEAVDNMLSNKISPLMNLISQEETSTPTQLVQGGAFDGTPRAPSTRATGRVPRGADEEEWVVAKDKPVYDELFYTLSPINGKISGVNAKKEMVTSKLPNSVLGKIWKLADCDCDGMLDEEEFALAKHLIKIKLDGYELPSSLPPHLVPPSHRKSLPKAD

SEQ ID NO: 26877 - protein, 363 aa, Homo sapiens
  Payload ID: 5298
  Gene Symbol: ELAC1
  Gene Name: elaC ribonuclease Z 1
  Uniprot ID: Q9H777
  ENSP ID: ENSP00000269466
MSMDVTFLGTGAAYPSPTRGASAVVLRCEGECWLFDCGEGTQTQLMKSQLKAGRITKIFITHLHGDHFFGLPGLLCTISLQSGSMVSKQPIEIYGPVGLRDFIWRTMELSHTELVFHYVVHELVPTADQCPAEELKEFAHVNRADSPPKEEQGRTILLDSEENSYLLFDDEQFVVKAFRLFHRIPSFGFSVVEKKRPGKLNAQKLKDLGVPPGPAYGKLKNGISVVLENGVTISPQDVLKKPIVGRKICILGDCSGVVGDGGVKLCFEADLLIHEATLDDAQMDKAKEHGHSTPQMAATFAKLCRAKRLVLTHFSQRYKPVALAREGETDGIAELKKQAESVLDLQEVTLAEDFMVISIPIKK

SEQ ID NO: 26878 - protein, 223 aa, Homo sapiens
  Payload ID: 5298
  Gene Symbol: ELAC1
  Gene Name: elaC ribonuclease Z 1
  ENSP ID: ENSP00000464770
MSMDVTFLGTGAAYPSPTRGASAVVLRCEGECWLFDCGEGTQTQLMKSQLKAGRITKIFITHLHGDHFFGLPGLLCTISLQSGSMVSKQPIEIYGPVGLRDFIWRTMELSHTELVFHYVVHELVPTADQCPAEELKEFAHVNRADSPPKEEQGRTILLDSEENSYLLFDDEQFVVKAFRLFHRIPSFGFSVVEKKRPGKLNAQKLKDLGKCFFVFCFFPPSHQ

SEQ ID NO: 26879 - protein, 88 aa, Homo sapiens
  Payload ID: 5298
  Gene Symbol: ELAC1
  Gene Name: elaC ribonuclease Z 1
  ENSP ID: ENSP00000467389
MSMDVTFLGTGAAYPSPTRGASAVVLRCEGECWLFDCGEGTQTQLMKSQLKAEFPHLGFQSWKRNAQVNSMHRNLKTLVFHQVLPMGS

SEQ ID NO: 26880 - protein, 826 aa, Homo sapiens
  Payload ID: 5299
  Gene Symbol: ELAC2
  Gene Name: elaC ribonuclease Z 2
  Uniprot ID: Q9BQ52
  ENSP ID: ENSP00000337445
MWALCSLLRSAAGRTMSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSESNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 26881 - protein, 807 aa, Homo sapiens
  Payload ID: 5299
  Gene Symbol: ELAC2
  Gene Name: elaC ribonuclease Z 2
  ENSP ID: ENSP00000379291
MWALCSLLRSAAGRTMSQGRTISQAPARRERPRKDPLRHLRTREKRGPSGCSGGPNTVYLQVVAAGSRDSGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSESNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 26882 - protein, 786 aa, Homo sapiens
  Payload ID: 5299
  Gene Symbol: ELAC2
  Gene Name: elaC ribonuclease Z 2
  Uniprot ID: Q9BQ52
  ENSP ID: ENSP00000405223
MWALCSLLRSAAGRTMSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 26883 - protein, 286 aa, Homo sapiens
  Payload ID: 5299
  Gene Symbol: ELAC2
  Gene Name: elaC ribonuclease Z 2
  ENSP ID: ENSP00000406192
  MOD_RES (1)..(1): Any amino acid
XPHGVSQRRGVRDSSLVVAFICKLHLKRGNFLVLKAKEMGLPVGTAAIAPIIAAVKDGKSITHEGREVLQILAEELCTPPDPGAAFVVVECPDESFIQPICENATFQRYQGKADAPVALVVHMAPASVLVDSRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNI

SEQ ID NO: 26884 - protein, 132 aa, Homo sapiens
  Payload ID: 5299
  Gene Symbol: ELAC2
  Gene Name: elaC ribonuclease Z 2
  ENSP ID: ENSP00000463321
MQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSESNENEPHLPH

SEQ ID NO: 26885 - protein, 148 aa, Homo sapiens
  Payload ID: 5299
  Gene Symbol: ELAC2
  Gene Name: elaC ribonuclease Z 2
  ENSP ID: ENSP00000463594
MQEHKLKVARLDNIFLTRMHWSNVGGLSGMILTLKETGLPKCVLSGPPQLEKYLEAIKIFSGPLKGIELAVRPHSAPEYEDETMTVYQIPIHSVSQRRGVRDSSLVVAFISSLKERKLLGAQSKGDGPPSWDSCHRSHHCCCQGREKH

SEQ ID NO: 26886 - protein, 626 aa, Homo sapiens
  Payload ID: 5299
  Gene Symbol: ELAC2
  Gene Name: elaC ribonuclease Z 2
  ENSP ID: ENSP00000463740
  MOD_RES (1)..(1): Any amino acid
XTMTVYQIPIHSEQRRGKHQPWQSPERPLSRLSPERSSDSESNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQQWMERFGPDTQHLVLNENCASVHNLRSHKIQTQLNLIHPDIFPLLTSFRCKKEGPTLSVPMVQGECLLKYQLRPRREWQRDAIITCNPEEFIVEALQLPNFQQSVQEYRRSAQDGPAPAEKRSQYPEIIFLGTGSAIPMKIRNVSATLVNISPDTSLLLDCGEGTFGQLCRHYGDQVDRVLGTLAAVFVSHLHADHHTGLPSILLQRERALASLGKPLHPLLVVAPNQLKAWLQQYHNQCQEVLHHISMIPAKCLQEGAEISSPAVERLISSLLRTCDLEEFQTCLVRHCKHAFGCALVHTSGWKVVYSGDTMPCEALVRMGKDATLLIHEATLEDGLEEEAVEKTHSTTSQAISVGMRMNAEFIMLNHFSQRYAKVPLFSPNFSEKVGVAFDHMKVCFGDFPTMPKLIPPLKALFAGDIEEMEERREKRELRQVRAALLSRELAGGLEDGEPQQKRAHTEEPQAKKVRAQ

SEQ ID NO: 26887 - protein, 45 aa, Homo sapiens
  Payload ID: 5299
  Gene Symbol: ELAC2
  Gene Name: elaC ribonuclease Z 2
  ENSP ID: ENSP00000463884
  MOD_RES (1)..(1): Any amino acid
XPVALVVHMAPASVLVDSRYQQWMERYGAQPSGTWGLGLTPSTWS

SEQ ID NO: 26888 - protein, 122 aa, Homo sapiens
  Payload ID: 5299
  Gene Symbol: ELAC2
  Gene Name: elaC ribonuclease Z 2
  ENSP ID: ENSP00000464358
MQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSE

SEQ ID NO: 26889 - protein, 242 aa, Homo sapiens
  Payload ID: 5299
  Gene Symbol: ELAC2
  Gene Name: elaC ribonuclease Z 2
  ENSP ID: ENSP00000477044
MQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSESNENEPHLPHGVSQRRGVRDSSLVVAFICKLHLKRGNFLVLKAKEMGLPVGTAAIAPIIAAVKDGKSITHEGREILAEELCTPPDPGAAFVVVECPDESFIQPICENATFQRYQGKADAP

SEQ ID NO: 26890 - protein, 124 aa, Homo sapiens
  Payload ID: 5299
  Gene Symbol: ELAC2
  Gene Name: elaC ribonuclease Z 2
  ENSP ID: ENSP00000477093
MQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSESN

SEQ ID NO: 26891 - protein, 158 aa, Homo sapiens
  Payload ID: 5299
  Gene Symbol: ELAC2
  Gene Name: elaC ribonuclease Z 2
  ENSP ID: ENSP00000477482
MWALCSLLRSAAGRTMSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLLCGPTLPQNTRMKP

SEQ ID NO: 26892 - protein, 267 aa, Homo sapiens
  Payload ID: 5300
  Gene Symbol: ELANE
  Gene Name: elastase, neutrophil expressed
  Uniprot ID: P08246
  ENSP ID: ENSP00000263621
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 26893 - protein, 267 aa, Homo sapiens; identical to SEQ ID NO: 26892
  Payload ID: 5300
  Gene Symbol: ELANE
  Gene Name: elastase, neutrophil expressed
  Uniprot ID: P08246
  ENSP ID: ENSP00000466090

SEQ ID NO: 26894 - protein, 267 aa, Homo sapiens; identical to SEQ ID NO: 26892
  Payload ID: 5300
  Gene Symbol: ELANE
  Gene Name: elastase, neutrophil expressed
  Uniprot ID: P08246
  ENSP ID: ENSP00000480128

SEQ ID NO: 26895 - protein, 267 aa, Homo sapiens; identical to SEQ ID NO: 26892
  Payload ID: 5300
  Gene Symbol: ELANE
  Gene Name: elastase, neutrophil expressed
  Uniprot ID: P08246
  ENSP ID: ENSP00000488075

SEQ ID NO: 26896 - protein, 724 aa, Homo sapiens
  Payload ID: 5301
  Gene Symbol: ELN
  Gene Name: elastin
  Uniprot ID: P15502
  ENSP ID: ENSP00000252034
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 26897 - protein, 757 aa, Homo sapiens
  Payload ID: 5301
  Gene Symbol: ELN
  Gene Name: elastin
  Uniprot ID: P15502
  ENSP ID: ENSP00000313565
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 26898 - protein, 643 aa, Homo sapiens
  Payload ID: 5301
  Gene Symbol: ELN
  Gene Name: elastin
  ENSP ID: ENSP00000315607
MAGLTAAAPRPGVLLLLLSILHPSRPGGVPGAIPGGVPGGVFYPGAGLGALGGGALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 26899 - protein, 711 aa, Homo sapiens
  Payload ID: 5301
  Gene Symbol: ELN
  Gene Name: elastin
  Uniprot ID: P15502
  ENSP ID: ENSP00000349540
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 26900 - protein, 786 aa, Homo sapiens
  Payload ID: 5301
  Gene Symbol: ELN
  Gene Name: elastin
  ENSP ID: ENSP00000351807
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGAAGAGVLGGLVPGAPGAVPGVPGTGGVPGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 26901 - protein, 570 aa, Homo sapiens
  Payload ID: 5301
  Gene Symbol: ELN
  Gene Name: elastin
  Uniprot ID: P15502
  ENSP ID: ENSP00000369926
MAGLTAAAPRPGVLLLLLSILHPSRPGGVPGAIPGGVPGGVFYPGAGLGALGGGALGPGGKPLKPVPGGLAGAGLGAGVGGAFAGIPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 26902 - protein, 730 aa, Homo sapiens
  Payload ID: 5301
  Gene Symbol: ELN
  Gene Name: elastin
  Uniprot ID: P15502
  ENSP ID: ENSP00000369936
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFALLNLAGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 26903 - protein, 677 aa, Homo sapiens
  Payload ID: 5301
  Gene Symbol: ELN
  Gene Name: elastin
  Uniprot ID: P15502
  ENSP ID: ENSP00000369949
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 26904 - protein, 705 aa, Homo sapiens
  Payload ID: 5301
  Gene Symbol: ELN
  Gene Name: elastin
  Uniprot ID: P15502
  ENSP ID: ENSP00000369950
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 26905 - protein, 658 aa, Homo sapiens
  Payload ID: 5301
  Gene Symbol: ELN
  Gene Name: elastin
  Uniprot ID: P15502
  ENSP ID: ENSP00000369958
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAGAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 26906 - protein, 168 aa, Homo sapiens
  Payload ID: 5301
  Gene Symbol: ELN
  Gene Name: elastin
  ENSP ID: ENSP00000389206
MAGLTAAAPRPGVLLLLLSILHPSRPGGVPGAIPGGVPGGVFYPGAGLGALGGGALGPGGKPLKPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAA

SEQ ID NO: 26907 - protein, 706 aa, Homo sapiens
  Payload ID: 5301
  Gene Symbol: ELN
  Gene Name: elastin
  ENSP ID: ENSP00000389857
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 26908 - protein, 692 aa, Homo sapiens
  Payload ID: 5301
  Gene Symbol: ELN
  Gene Name: elastin
  Uniprot ID: P15502
  ENSP ID: ENSP00000391129
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 26909 - protein, 700 aa, Homo sapiens
  Payload ID: 5301
  Gene Symbol: ELN
  Gene Name: elastin
  ENSP ID: ENSP00000392575
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 26910 - protein, 151 aa, Homo sapiens
  Payload ID: 5301
  Gene Symbol: ELN
  Gene Name: elastin
  ENSP ID: ENSP00000394549
MAGLTAAAPRPGVLLLLLSILHPSRPGGVPGAIPGGVPGGVFYPALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGA

SEQ ID NO: 26911 - protein, 166 aa, Homo sapiens
  Payload ID: 5301
  Gene Symbol: ELN
  Gene Name: elastin
  ENSP ID: ENSP00000399499
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGVGPFGGPQPGVPLGYPIKAPKLPGGYGLPYTTGKLPYGYGPGGVAGAAGKAGYPTGT

SEQ ID NO: 26912 - protein, 714 aa, Homo sapiens
  Payload ID: 5301
  Gene Symbol: ELN
  Gene Name: elastin
  ENSP ID: ENSP00000403162
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 26913 - protein, 176 aa, Homo sapiens
  Payload ID: 5301
  Gene Symbol: ELN
  Gene Name: elastin
  ENSP ID: ENSP00000403961
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGGAFAGIPGVGPFGGPQPGVPLGYPIKAPKLP

SEQ ID NO: 26914 - protein, 68 aa, Homo sapiens
  Payload ID: 5301
  Gene Symbol: ELN
  Gene Name: elastin
  ENSP ID: ENSP00000404138
MAGLTAAAPRPGVLLLLLSILHPSRPGGVPGAIPGGVPGGVFYPGNVHETSTHPGHADDADVHNRCTF

SEQ ID NO: 26915 - protein, 294 aa, Homo sapiens
  Payload ID: 5301
  Gene Symbol: ELN
  Gene Name: elastin
  ENSP ID: ENSP00000406949
MAGLTAAAPRPGVLLLLLSILHPSRPGGVPGAIPGGVPGGVFYPGAGLGALGGGALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKY

SEQ ID NO: 26916 - protein, 214 aa, Homo sapiens
  Payload ID: 5301
  Gene Symbol: ELN
  Gene Name: elastin
  ENSP ID: ENSP00000411092
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGVGPFGGPQPGVPLGYPIKAPKLPGGYGLPYTTGKLPYGYGPGGVAGAAGKAGYPTGT

SEQ ID NO: 26917 - protein, 60 aa, Homo sapiens
  Payload ID: 5301
  Gene Symbol: ELN
  Gene Name: elastin
  ENSP ID: ENSP00000412262
VTFPGALVPGGVADAAAAYKAAKAGAGLGGVPGVGGLGVSAGAVVPQPGAGVKPGKVPAL

SEQ ID NO: 26918 - protein, 617 aa, Homo sapiens
  Payload ID: 5301
  Gene Symbol: ELN
  Gene Name: elastin
  ENSP ID: ENSP00000480955
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 26919 - protein, 1016 aa, Homo sapiens
  Payload ID: 5302
  Gene Symbol: EMILIN1
  Gene Name: elastin microfibril interfacer 1
  ENSP ID: ENSP00000369677
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAGEARQATLEGLQEVVGRLQDRVDAQDETAAEFTLRLNLTAARLGQLEGLLQAHGDEGCGACGGVQEELGRLRDGVERCSCPLLPPRGPGAGPGVGGPSRGPLDGFSVFGGSSGSALQALQGELSEVILSFSSLNDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 26920 - protein, 347 aa, Homo sapiens
  Payload ID: 5302
  Gene Symbol: EMILIN1
  Gene Name: elastin microfibril interfacer 1
  ENSP ID: ENSP00000411201
  MOD_RES (1)..(1): Any amino acid
XADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGEGTKGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 26921 - protein, 1053 aa, Homo sapiens
  Payload ID: 5303
  Gene Symbol: EMILIN2
  Gene Name: elastin microfibril interfacer 2
  Uniprot ID: Q9BXX0
  ENSP ID: ENSP00000254528
MWQPRRPWPRVPWRWALALLALVGAGLCHAGPQPGYPARPSARNKNWCAYIVNKNVSCSVLEGSESFIQAQYNCAWNQMPCPSALVYRVNFRPRYVTRYKTVTQLEWRCCPGFRGGDCQEGPKDPVKTLRPTPARPRNSLKKATDNEPSQFSEPRKTLSPTGTAQPSWGVDPKEGPQELQEKKIQVLEEKVLRLTRTVLDLQSSLAGVSENLKHATQDDASRTRAPGLSSQHPKPDTTVSGDTETGQSPGVFNTKESGMKDIKSELAEVKDTLKNKSDKLEELDGKVKGYEGQLRQLQEAAQGPTVTMTTNELYQAYVDSKIDALREELMEGMDRKLADLKNSCEYKLTGLQQQCDDYGSSYLGVIELIGEKETSLRKEINNLRARLQEPSAQANCCDSEKNGDIGQQIKTLDQKIERVAEATRMLNGRLDNEFDRLIVPEPDVDFDAKWNELDARINVTEKNAEEHCFYIEETLRGAINGEVGDLKQLVDQKIQSLEDRLGSVLLQMTNNTGAELSPPGAAALPGVSGSGDERVMMELNHLKDKVQVVEDICLLNIQGKPHGMEGALPNREDRAVRDSLHLLKSLNDTMHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 26922 - protein, 766 aa, Homo sapiens
  Payload ID: 5304
  Gene Symbol: EMILIN3
  Gene Name: elastin microfibril interfacer 3
  Uniprot ID: Q9NT22
  ENSP ID: ENSP00000332806
MGRRRLLVWLCAVAALLSGAQARGTPLLARPAPPGASRYSLYTTGWRPRLRPGPHKALCAYVVHRNVTCILQEGAESYVKAEYRQCRWGPKCPGTVTYRTVLRPKYKVGYKTVTDLAWRCCPGFTGKRCPEHLTDHGAASPQLEPEPQIPSGQLDPGPRPPSYSRAAPSPHGRKGPGLFGERLERLEGDVQRLAQTYGTLSGLVASHEDPNRMTGGPRAPAVPVGFGVIPEGLVGPGDRARGPLTPPLDEILSKVTEVSNTLQTKVQLLDKVHGLALGHEAHLQRLREAPPSPLTSLALLEEYVDRRLHRLWGSLLDGFEQKLQGVQSECDLRVQEVRRQCEEGQAASRRLHQSLDGRELALRQELSQLGSQLQGLSVSGRGSCCGQLALINARMDGLERALQAVTETQRGPGAPAGDELTRLSAAMLEGGVDGLLEGLETLNGTEGGARGCCLRLDMGGWGVGGFGTMLEERVQSLEERLATLAGELSHDSASPGRSARPLVQTELAVLEQRLVSLETSCTPSTTSAILDSLVAEVKAWQSRSEALLRQVASHAALLQQLNGTVAEVQGQLAEGTGSSLQGEITLLKVNLNSVSKSLTGLSDSVSQYSDAFLAANTSLDERERKVEAEVQAIQEQVSSQGSRLQAGHRQVLNLRGELEQLKAGVAKVASGLSRCQDTAQKLQHTVGHFDQRVAQVEGACRRLGLLAAGLDSLPTEPLRPREGLWSHVDQLNRTLAQHTQDIARLRDDLLDCQAQLAEQVRPGQAN

SEQ ID NO: 26923 - protein, 346 aa, Homo sapiens
  Payload ID: 5305
  Gene Symbol: ELAVL2
  Gene Name: ELAV like neuron-specific RNA binding protein 2
  Uniprot ID: Q12926
  ENSP ID: ENSP00000223951
METQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRFSPMTIDGMTSLAGINIPGHPGTGWCIFVYNLAPDADESILWQMFGPFGAVTNVKVIRDFNTNKCKGFGFVTMTNYDEAAMAIASLNGYRLGDRVLQVSFKTNKTHKA

SEQ ID NO: 26924 - protein, 389 aa, Homo sapiens
  Payload ID: 5305
  Gene Symbol: ELAVL2
  Gene Name: ELAV like neuron-specific RNA binding protein 2
  ENSP ID: ENSP00000369453
MAVRLCDVASLLRSGSWAAEPWTGQVIAAMETQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRLDNLLNMAYGVKSRFSPMTIDGMTSLAGINIPGHPGTGWCIFVYNLAPDADESILWQMFGPFGAVTNVKVIRDFNTNKCKGFGFVTMTNYDEAAMAIASLNGYRLGDRVLQVSFKTNKTHKA

SEQ ID NO: 26925 - protein, 359 aa, Homo sapiens
  Payload ID: 5305
  Gene Symbol: ELAVL2
  Gene Name: ELAV like neuron-specific RNA binding protein 2
  Uniprot ID: Q12926
  ENSP ID: ENSP00000369460
METQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRLDNLLNMAYGVKRFSPMTIDGMTSLAGINIPGHPGTGWCIFVYNLAPDADESILWQMFGPFGAVTNVKVIRDFNTNKCKGFGFVTMTNYDEAAMAIASLNGYRLGDRVLQVSFKTNKTHKA

SEQ ID NO: 26926 - protein, 359 aa, Homo sapiens; identical to SEQ ID NO: 26925
  Payload ID: 5305
  Gene Symbol: ELAVL2
  Gene Name: ELAV like neuron-specific RNA binding protein 2
  Uniprot ID: Q12926
  ENSP ID: ENSP00000380479

SEQ ID NO: 26927 - protein, 90 aa, Homo sapiens
  Payload ID: 5305
  Gene Symbol: ELAVL2
  Gene Name: ELAV like neuron-specific RNA binding protein 2
  ENSP ID: ENSP00000391757
MTQKELEQLFSQYGRIITSRILVDQVTGISRGVGFIRFDKRIEAEEAIKGLNGQKPPGATEPITVKFANNPSQKTNQAILSQLYQSPNRR

SEQ ID NO: 26928 - protein, 189 aa, Homo sapiens
  Payload ID: 5305
  Gene Symbol: ELAVL2
  Gene Name: ELAV like neuron-specific RNA binding protein 2
  ENSP ID: ENSP00000412602
METQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQ

SEQ ID NO: 26929 - protein, 359 aa, Homo sapiens; identical to SEQ ID NO: 26925
  Payload ID: 5305
  Gene Symbol: ELAVL2
  Gene Name: ELAV like neuron-specific RNA binding protein 2
  Uniprot ID: Q12926
  ENSP ID: ENSP00000440998

SEQ ID NO: 26930 - protein, 367 aa, Homo sapiens
  Payload ID: 5306
  Gene Symbol: ELAVL3
  Gene Name: ELAV like neuron-specific RNA binding protein 3
  Uniprot ID: Q14576
  ENSP ID: ENSP00000352162
MVTQILGAMESQVGGGPAGPALPNGPLLGTNGATDDSKTNLIVNYLPQNMTQDEFKSLFGSIGDIESCKLVRDKITGQSLGYGFVNYSDPNDADKAINTLNGLKLQTKTIKVSYARPSSASIRDANLYVSGLPKTMSQKEMEQLFSQYGRIITSRILVDQVTGVSRGVGFIRFDKRIEAEEAIKGLNGQKPLGAAEPITVKFANNPSQKTGQALLTHLYQSSARRYAGPLHHQTQRFRLDNLLNMAYGVKSPLSLIARFSPIAIDGMSGLAGVGLSGGAAGAGWCIFVYNLSPEADESVLWQLFGPFGAVTNVKVIRDFTTNKCKGFGFVTMTNYDEAAMAIASLNGYRLGERVLQVSFKTSKQHKA

SEQ ID NO: 26931 - protein, 360 aa, Homo sapiens
  Payload ID: 5306
  Gene Symbol: ELAVL3
  Gene Name: ELAV like neuron-specific RNA binding protein 3
  Uniprot ID: Q14576
  ENSP ID: ENSP00000390878
MVTQILGAMESQVGGGPAGPALPNGPLLGTNGATDDSKTNLIVNYLPQNMTQDEFKSLFGSIGDIESCKLVRDKITGQSLGYGFVNYSDPNDADKAINTLNGLKLQTKTIKVSYARPSSASIRDANLYVSGLPKTMSQKEMEQLFSQYGRIITSRILVDQVTGVSRGVGFIRFDKRIEAEEAIKGLNGQKPLGAAEPITVKFANNPSQKTGQALLTHLYQSSARRYAGPLHHQTQRFRLDNLLNMAYGVKRFSPIAIDGMSGLAGVGLSGGAAGAGWCIFVYNLSPEADESVLWQLFGPFGAVTNVKVIRDFTTNKCKGFGFVTMTNYDEAAMAIASLNGYRLGERVLQVSFKTSKQHKA

SEQ ID NO: 26932 - protein, 92 aa, Homo sapiens
  Payload ID: 5306
  Gene Symbol: ELAVL3
  Gene Name: ELAV like neuron-specific RNA binding protein 3
  ENSP ID: ENSP00000467314
MVTQILGAMESQVGGGPAGPALPNGPLLGTNGATDDSKTNLIVNYLPQNMTQDEFKSLFGSIGDIESCKLVRDKITDKAINTLNGLKLQTKT

SEQ ID NO: 26933 - protein, 402 aa, Homo sapiens
  Payload ID: 5307
  Gene Symbol: ELAVL4
  Gene Name: ELAV like neuron-specific RNA binding protein 4
  ENSP ID: ENSP00000349594
MLRYLQPLGCVHGGKGLTDMRLLLLREIVINESRNCSFMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 26934 - protein, 371 aa, Homo sapiens
  Payload ID: 5307
  Gene Symbol: ELAVL4
  Gene Name: ELAV like neuron-specific RNA binding protein 4
  ENSP ID: ENSP00000360884
MEWNGLKMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 26935 - protein, 385 aa, Homo sapiens
  Payload ID: 5307
  Gene Symbol: ELAVL4
  Gene Name: ELAV like neuron-specific RNA binding protein 4
  ENSP ID: ENSP00000360886
MEWNGLKMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRLMSGPVPPSACPPRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 26936 - protein, 380 aa, Homo sapiens
  Payload ID: 5307
  Gene Symbol: ELAVL4
  Gene Name: ELAV like neuron-specific RNA binding protein 4
  Uniprot ID: P26378
  ENSP ID: ENSP00000360888
MVMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRLMSGPVPPSACPPRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 26937 - protein, 366 aa, Homo sapiens
  Payload ID: 5307
  Gene Symbol: ELAVL4
  Gene Name: ELAV like neuron-specific RNA binding protein 4
  Uniprot ID: P26378
  ENSP ID: ENSP00000360889
MVMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 26938 - protein, 366 aa, Homo sapiens
  Payload ID: 5307
  Gene Symbol: ELAVL4
  Gene Name: ELAV like neuron-specific RNA binding protein 4
  Uniprot ID: P26378
  ENSP ID: ENSP00000360892
MEQIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 26939 - protein, 369 aa, Homo sapiens
  Payload ID: 5307
  Gene Symbol: ELAVL4
  Gene Name: ELAV like neuron-specific RNA binding protein 4
  Uniprot ID: P26378
  ENSP ID: ENSP00000399939
MRLKNQIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 26940 - protein, 326 aa, Homo sapiens
  Payload ID: 5308
  Gene Symbol: ELAVL1
  Gene Name: ELAV like RNA binding protein 1
  Uniprot ID: Q15717
  ENSP ID: ENSP00000264073
MSNGYEDHMAEDCRGDIGRTNLIVNYLPQNMTQDELRSLFSSIGEVESAKLIRDKVAGHSLGYGFVNYVTAKDAERAINTLNGLRLQSKTIKVSYARPSSEVIKDANLYISGLPRTMTQKDVEDMFSRFGRIINSRVLVDQTTGLSRGVAFIRFDKRSEAEEAITSFNGHKPPGSSEPITVKFAANPNQNKNVALLSQLYHSPARRFGGPVHHQAQRFRFSPMGVDHMSGLSGVNVPGNASSGWCIFIYNLGQDADEGILWQMFGPFGAVTNVKVIRDFNTNKCKGFGFVTMTNYEEAAMAIASLNGYRLGDKILQVSFKTNKSHK

SEQ ID NO: 26941 - protein, 326 aa, Homo sapiens; identical to SEQ ID NO: 26940
  Payload ID: 5308
  Gene Symbol: ELAVL1
  Gene Name: ELAV like RNA binding protein 1
  Uniprot ID: Q15717
  ENSP ID: ENSP00000385269

SEQ ID NO: 26942 - protein, 153 aa, Homo sapiens
  Payload ID: 5308
  Gene Symbol: ELAVL1
  Gene Name: ELAV like RNA binding protein 1
  ENSP ID: ENSP00000470727
MSNGYEDHMAEDCRGDIGRTNLIVNYLPQNMTQDELRSLFSSIGEVESAKLIRDKVAGHSLGYGFVNYVTAKDAERAINTLNGLRLQSKTIKVSYARPSSEVIKDANLYISGLPRTMTQKDVEDMFSRFGRIINSRVLVDQTTVIPQTRTAPK

SEQ ID NO: 26943 - protein, 133 aa, Homo sapiens
  Payload ID: 5308
  Gene Symbol: ELAVL1
  Gene Name: ELAV like RNA binding protein 1
  ENSP ID: ENSP00000471011
GLRLQSKTIKVSYARPSSEVIKDANLYISGLPRTMTQKDVEDMFSRFGRIINSRVLVDQTTESQILRKSQNRGPLPGFDTKEGPCSVAREQSASWDQNAFLEKEAFQVSLGQHLLMEGGSQHPSDGRWEPTPF

SEQ ID NO: 26944 - protein, 326 aa, Homo sapiens; identical to SEQ ID NO: 26940
  Payload ID: 5308
  Gene Symbol: ELAVL1
  Gene Name: ELAV like RNA binding protein 1
  Uniprot ID: Q15717
  ENSP ID: ENSP00000472197

SEQ ID NO: 26945 - protein, 64 aa, Homo sapiens
  Payload ID: 5309
  Gene Symbol: ETFA
  Gene Name: electron-transfer-flavoprotein, alpha polypeptide
  ENSP ID: ENSP00000267950
MFRAAAPGQLRRAASLLRFQSTLVIAEHANDSLAPITLNTITAATRLGGEVSCLVAGTKCDKRN

SEQ ID NO: 26946 - protein, 284 aa, Homo sapiens
  Payload ID: 5309
  Gene Symbol: ETFA
  Gene Name: electron-transfer-flavoprotein, alpha polypeptide
  Uniprot ID: P13804
  ENSP ID: ENSP00000399273
MFRAAAPGQLRRAVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 26947 - protein, 229 aa, Homo sapiens
  Payload ID: 5309
  Gene Symbol: ETFA
  Gene Name: electron-transfer-flavoprotein, alpha polypeptide
  ENSP ID: ENSP00000452659
MFRAAAPGQLRRANLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 26948 - protein, 333 aa, Homo sapiens
  Payload ID: 5309
  Gene Symbol: ETFA
  Gene Name: electron-transfer-flavoprotein, alpha polypeptide
  Uniprot ID: P13804
  ENSP ID: ENSP00000452762
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 26949 - protein, 289 aa, Homo sapiens
  Payload ID: 5309
  Gene Symbol: ETFA
  Gene Name: electron-transfer-flavoprotein, alpha polypeptide
  ENSP ID: ENSP00000452777
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGDGVSLLLPRLECNGTISAHRHLHLPGSSDSPASASRVAGITGRGLKSGENFKLLYDLADQLHAAVGAS

SEQ ID NO: 26950 - protein, 45 aa, Homo sapiens
  Payload ID: 5309
  Gene Symbol: ETFA
  Gene Name: electron-transfer-flavoprotein, alpha polypeptide
  ENSP ID: ENSP00000452942
MFRAAAPGQLRRARRGFPMLPRLVSNSCPQVIHLPRPPKVLELQA

SEQ ID NO: 26951 - protein, 239 aa, Homo sapiens
  Payload ID: 5309
  Gene Symbol: ETFA
  Gene Name: electron-transfer-flavoprotein, alpha polypeptide
  ENSP ID: ENSP00000453017
  MOD_RES (1)..(1): Any amino acid
XAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGVETEVLHVGQAGLEILTSGDPPTSASQSVGITGRGLKSGENFKLLYDLADQLHAAVGASRAAVDAGFVPNDMQVGQTGKI

SEQ ID NO: 26952 - protein, 73 aa, Homo sapiens
  Payload ID: 5309
  Gene Symbol: ETFA
  Gene Name: electron-transfer-flavoprotein, alpha polypeptide
  ENSP ID: ENSP00000453098
MQVGQTGKIVAPELYIAVGISGAIQHLAGMKDSKTIVAINKDPEAPIFQVADYGIVADLFKVVPEMTEILKKK

SEQ ID NO: 26953 - protein, 303 aa, Homo sapiens
  Payload ID: 5309
  Gene Symbol: ETFA
  Gene Name: electron-transfer-flavoprotein, alpha polypeptide
  ENSP ID: ENSP00000453345
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGVGASRAAVDAGFVPNDMQVGQTGKIVAPELYIAVGISGAIQHLAGMKDSKTIVAINKDPEAPIFQVADYGIVADLFKVVPEM

SEQ ID NO: 26954 - protein, 39 aa, Homo sapiens
  Payload ID: 5309
  Gene Symbol: ETFA
  Gene Name: electron-transfer-flavoprotein, alpha polypeptide
  ENSP ID: ENSP00000453422
MQVGQTGKIVAPELYIAVGISGAIQHLAGMKDSKHVSLD

SEQ ID NO: 26955 - protein, 45 aa, Homo sapiens; identical to SEQ ID NO: 26950
  Payload ID: 5309
  Gene Symbol: ETFA
  Gene Name: electron-transfer-flavoprotein, alpha polypeptide
  ENSP ID: ENSP00000453753

SEQ ID NO: 26956 - protein, 254 aa, Homo sapiens
  Payload ID: 5309
  Gene Symbol: ETFA
  Gene Name: electron-transfer-flavoprotein, alpha polypeptide
  ENSP ID: ENSP00000454194
  MOD_RES (1)..(1): Any amino acid
XATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKPPWTALLCPSSHKAALHWKLQLQPLHCHD

SEQ ID NO: 26957 - protein, 46 aa, Homo sapiens
  Payload ID: 5309
  Gene Symbol: ETFA
  Gene Name: electron-transfer-flavoprotein, alpha polypeptide
  ENSP ID: ENSP00000458001
ELYIAVGISGAIQHLAGMKDSKLPGLYHVPILDILASSAHLSEEPL

SEQ ID NO: 26958 - protein, 255 aa, Homo sapiens
  Payload ID: 5310
  Gene Symbol: ETFB
  Gene Name: electron-transfer-flavoprotein, beta polypeptide
  Uniprot ID: P38117
  ENSP ID: ENSP00000311930
MAELRVLVAVKRVIDYAVKIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 26959 - protein, 346 aa, Homo sapiens
  Payload ID: 5310
  Gene Symbol: ETFB
  Gene Name: electron-transfer-flavoprotein, beta polypeptide
  Uniprot ID: P38117
  ENSP ID: ENSP00000346173
MYLSLWVTINTVNLRNTLSGLRGAVTTVGMIKSDVPGTQEWLDERRRQGDLPLPTNSNPVLSLELCDPGQGPAPFQAVVVLIQPGRGLALRPPPSCLFPPDPTPSPPAGQIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 26960 - protein, 178 aa, Homo sapiens
  Payload ID: 5310
  Gene Symbol: ETFB
  Gene Name: electron-transfer-flavoprotein, beta polypeptide
  ENSP ID: ENSP00000469628
MAELRVLVAVKRVIDYAVKIRVKPDRTGVVTDGVKHSMNPFCEIAVEEAVRLKEKKLVKEVIAVSCGPAQCQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPP

SEQ ID NO: 26961 - protein, 570 aa, Homo sapiens
  Payload ID: 5311
  Gene Symbol: ETFDH
  Gene Name: electron-transferring-flavoprotein dehydrogenase
  Uniprot ID: Q16134
  ENSP ID: ENSP00000303552
MLVPLAKLSCLGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 26962 - protein, 164 aa, Homo sapiens
  Payload ID: 5311
  Gene Symbol: ETFDH
  Gene Name: electron-transferring-flavoprotein dehydrogenase
  ENSP ID: ENSP00000422735
MNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDY

SEQ ID NO: 26963 - protein, 38 aa, Homo sapiens
  Payload ID: 5311
  Gene Symbol: ETFDH
  Gene Name: electron-transferring-flavoprotein dehydrogenase
  ENSP ID: ENSP00000425661
MLVPLAKLSCLDGLQLLLCLELLPIILFIPGIRTRDGK

SEQ ID NO: 26964 - protein, 617 aa, Homo sapiens
  Payload ID: 5311
  Gene Symbol: ETFDH
  Gene Name: electron-transferring-flavoprotein dehydrogenase
  Uniprot ID: Q16134
  ENSP ID: ENSP00000426638
MLVPLAKLSCLAYQCFHALKIKKNYLPLCATRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 26965 - protein, 83 aa, Homo sapiens
  Payload ID: 5312
  Gene Symbol: ELOF1
  Gene Name: ELF1 homolog, elongation factor 1
  Uniprot ID: P60002
  ENSP ID: ENSP00000252445
MGRRKSKRKPPPKKKMTGTLETQFTCPFCNHEKSCDVKMDRARNTGVISCTVCLEEFQTPITYLSEPVDVYSDWIDACEAANQ

SEQ ID NO: 26966 - protein, 104 aa, Homo sapiens
  Payload ID: 5312
  Gene Symbol: ELOF1
  Gene Name: ELF1 homolog, elongation factor 1
  ENSP ID: ENSP00000465765
MVRSRLTAVSASWVQAHPPADMGRRKSKRKPPPKKKMTGTLETQFTCPFCNHEKSCDVKMDRARNTGVISCTVCLEEFQTPITYLSEPVDVYSDWIDACEAANQ

SEQ ID NO: 26967 - protein, 14 aa, Homo sapiens
  Payload ID: 5312
  Gene Symbol: ELOF1
  Gene Name: ELF1 homolog, elongation factor 1
  ENSP ID: ENSP00000465973
MVRSRLTAVSASWV

SEQ ID NO: 26968 - protein, 120 aa, Homo sapiens
  Payload ID: 5312
  Gene Symbol: ELOF1
  Gene Name: ELF1 homolog, elongation factor 1
  ENSP ID: ENSP00000466665
MGRRKSKRKPPPKKKMTGTLETQFTCPFCNHEKSCDVKMDRARNTGVISCTVCLEEFQTPITCILGNLGFFQRVGRGLESGPCSSGPLCALVQGQSRPEEQVPPSDFCGVRRCRAGFQCQ

SEQ ID NO: 26969 - protein, 76 aa, Homo sapiens
  Payload ID: 5312
  Gene Symbol: ELOF1
  Gene Name: ELF1 homolog, elongation factor 1
  ENSP ID: ENSP00000466732
MGRRKSKRKPPPKKKMTGTLETQFTCPFCNHEKSCDVKMDRARNTGVISCTVCLEEFQTPITSQICQNPWMCTVIG

SEQ ID NO: 26970 - protein, 83 aa, Homo sapiens; identical to SEQ ID NO: 26965
  Payload ID: 5312
  Gene Symbol: ELOF1
  Gene Name: ELF1 homolog, elongation factor 1
  Uniprot ID: P60002
  ENSP ID: ENSP00000467264

SEQ ID NO: 26971 - protein, 90 aa, Homo sapiens
  Payload ID: 5312
  Gene Symbol: ELOF1
  Gene Name: ELF1 homolog, elongation factor 1
  ENSP ID: ENSP00000467330
MAHPPADMGRRKSKRKPPPKKKMTGTLETQFTCPFCNHEKSCDVKMDRARNTGVISCTVCLEEFQTPITYLSEPVDVYSDWIDACEAANQ

SEQ ID NO: 26972 - protein, 114 aa, Homo sapiens
  Payload ID: 5312
  Gene Symbol: ELOF1
  Gene Name: ELF1 homolog, elongation factor 1
  ENSP ID: ENSP00000467664
MGRRKSKRKPPPKKKMTGTLETQFTCPFCNHEKSCDVKMDRARNTGVISCTVCLEEFQTPITSSAHPLLSVMSWVLRLPGHQKKERGPEALTFGRWPGGPCDQPFKPPSVLFSQ

SEQ ID NO: 26973 - protein, 83 aa, Homo sapiens; identical to SEQ ID NO: 26965
  Payload ID: 5312
  Gene Symbol: ELOF1
  Gene Name: ELF1 homolog, elongation factor 1
  Uniprot ID: P60002
  ENSP ID: ENSP00000467914

SEQ ID NO: 26974 - protein, 428 aa, Homo sapiens
  Payload ID: 5313
  Gene Symbol: ELK1
  Gene Name: ELK1, member of ETS oncogene family
  Uniprot ID: P19419
  ENSP ID: ENSP00000247161
MDPSVTLWQFLLQLLREQGNGHIISWTSRDGGEFKLVDAEEVARLWGLRKNKTNMNYDKLSRALRYYYDKNIIRKVSGQKFVYKFVSYPEVAGCSTEDCPPQPEVSVTSTMPNVAPAAIHAAPGDTVSGKPGTPKGAGMAGPGGLARSSRNEYMRSGLYSTFTIQSLQPQPPPHPRPAVVLPSAAPAGAAAPPSGSRSTSPSPLEACLEAEEAGLPLQVILTPPEAPNLKSEELNVEPGLGRALPPEVKVEGPKEELEVAGERGFVPETTKAEPEVPPQEGVPARLPAVVMDTAGQAGGHAASSPEISQPQKGRKPRDLELPLSPSLLGGPGPERTPGSGSGSGLQAPGPALTPSLLPTHTLTPVLLTPSSLPPSIHFWSTLSPIAPRSPAKLSFQFPSSGSAQVHIPSISVDGLSTPVVLSPGPQKP

SEQ ID NO: 26975 - protein, 95 aa, Homo sapiens
  Payload ID: 5313
  Gene Symbol: ELK1
  Gene Name: ELK1, member of ETS oncogene family
  Uniprot ID: P19419
  ENSP ID: ENSP00000345585
MDPSVTLWQFLLQLLREQGNGHIISWTSRDGGEFKLVDAEEVARLWGLRKNKTNMNYDKLSRALRYYYDKNIIRKVSGQKFVYKFVSYPESHCAP

SEQ ID NO: 26976 - protein, 428 aa, Homo sapiens; identical to SEQ ID NO: 26974
  Payload ID: 5313
  Gene Symbol: ELK1
  Gene Name: ELK1, member of ETS oncogene family
  Uniprot ID: P19419
  ENSP ID: ENSP00000366182

SEQ ID NO: 26977 - protein, 407 aa, Homo sapiens
  Payload ID: 5314
  Gene Symbol: ELK3
  Gene Name: ELK3, ETS-domain protein (SRF accessory protein 2)
  Uniprot ID: P41970
  ENSP ID: ENSP00000228741
MESAITLWQFLLQLLLDQKHEHLICWTSNDGEFKLLKAEEVAKLWGLRKNKTNMNYDKLSRALRYYYDKNIIKKVIGQKFVYKFVSFPEILKMDPHAVEISRESLLLQDSDCKASPEGREAHKHGLAALRSTSRNEYIHSGLYSSFTINSLQNPPDAFKAIKTEKLEEPPEDSPPVEEVRTVIRFVTNKTDKHVTRPVVSLPSTSEAAAASAFLASSVSAKISSLMLPNAASISSASPFSSRSPSLSPNSPLPSEHRSLFLEAACHDSDSLEPLNLSSGSKTKSPSLPPKAKKPKGLEISAPPLVLSGTDIGSIALNSPALPSGSLTPAFFTAQTPNGLLLTPSPLLSSIHFWSSLSPVAPLSPARLQGPSTLFQFPTLLNGHMPVPIPSLDRAASPVLLSSNSQKS

SEQ ID NO: 26978 - protein, 38 aa, Homo sapiens
  Payload ID: 5314
  Gene Symbol: ELK3
  Gene Name: ELK3, ETS-domain protein (SRF accessory protein 2)
  ENSP ID: ENSP00000446806
MESAITLWQFLLQLLLDQKHEHLICWTSNDGEFKLLKA

SEQ ID NO: 26979 - protein, 159 aa, Homo sapiens
  Payload ID: 5314
  Gene Symbol: ELK3
  Gene Name: ELK3, ETS-domain protein (SRF accessory protein 2)
  ENSP ID: ENSP00000447857
MESAITLWQFLLQLLLDQKHEHLICWTSNDGEFKLLKAEEVAKLWGLRKNKTNMNYDKLSRALRYYYDKNIIKKVIGQKFVYKFVSFPEILKMDPHAVEISRESLLLQDSDCKASPEGREAHKHGLAALRSTSRNEYIHSGLYSSFTINSLQNPPDAFK

SEQ ID NO: 26980 - protein, 102 aa, Homo sapiens
  Payload ID: 5314
  Gene Symbol: ELK3
  Gene Name: ELK3, ETS-domain protein (SRF accessory protein 2)
  ENSP ID: ENSP00000449420
  MOD_RES (1)..(1): Any amino acid
XRNEYIHSGLYSSFTINSLQNPPDAFKAIKTEKLEEPPEDSPPVEEVRTVIRPKNPKAWKSQRPRWCSPAPTSAPSPSTAQPSPRDPSPQPSSPHRHQMDCF

SEQ ID NO: 26981 - protein, 142 aa, Homo sapiens
  Payload ID: 5314
  Gene Symbol: ELK3
  Gene Name: ELK3, ETS-domain protein (SRF accessory protein 2)
  ENSP ID: ENSP00000449430
MESAITLWQFLLQLLLDQKHEHLICWTSNDGEFKLLKAEEVAKLWGLRKNKTNMNYDKLSRALRYYYDKTPNGLLLTPSPLLSSIHFWSSLSPVAPLSPARLQGPSTLFQFPTLLNGHMPVPIPSLDRAASPVLLSSNSQKS

SEQ ID NO: 26982 - protein, 405 aa, Homo sapiens
  Payload ID: 5315
  Gene Symbol: ELK4
  Gene Name: ELK4, ETS-domain protein (SRF accessory protein 1)
  Uniprot ID: P28324
  ENSP ID: ENSP00000289703
MDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQVACSLFMVSPLLSFICPFKQIQNLYTQVCFLLLRFVLERLCVTVM

SEQ ID NO: 26983 - protein, 431 aa, Homo sapiens
  Payload ID: 5315
  Gene Symbol: ELK4
  Gene Name: ELK4, ETS-domain protein (SRF accessory protein 1)
  Uniprot ID: P28324
  ENSP ID: ENSP00000350681
MDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHSGLYSSFTLNSLNSSNVKLFKLIKTENPAEKLAEKKSPQEPTPSVIKFVTTPSKKPPVEPVAATISIGPSISPSSEETIQALETLVSPKLPSLEAPTSASNVMTAFATTPPISSIPPLQEPPRTPSPPLSSHPDIDTDIDSVASQPMELPENLSLEPKDQDSVLLEKDKVNNSSRSKKPKGLELAPTLVITSSDPSPLGILSPSLPTASLTPAFFSQTPIILTPSPLLSSIHFWSTLSPVAPLSPARLQGANTLFQFPSVLNSHGPFTLSGLDGPSTPGPFSPDLQKT

SEQ ID NO: 26984 - protein, 431 aa, Homo sapiens; identical to SEQ ID NO: 26983
  Payload ID: 5315
  Gene Symbol: ELK4
  Gene Name: ELK4, ETS-domain protein (SRF accessory protein 1)
  Uniprot ID: P28324
  ENSP ID: ENSP00000483628

SEQ ID NO: 26985 - protein, 144 aa, Homo sapiens
  Payload ID: 5315
  Gene Symbol: ELK4
  Gene Name: ELK4, ETS-domain protein (SRF accessory protein 1)
  ENSP ID: ENSP00000484946
MDSAITLWQFLLQLLQKPQNKHMICWTSNDGQFKLLQAEEVARLWGIRKNKPNMNYDKLSRALRYYYVKNIIKKVNGQKFVYKFVSYPEILNMDPMTVGRIEGDCESLNFSEVSSSSKDVENGGKDKPPQPGAKTSSRNDYIHS

SEQ ID NO: 26986 - protein, 948 aa, Homo sapiens
  Payload ID: 5316
  Gene Symbol: ERC1
  Gene Name: ELKS/RAB6-interacting/CAST family member 1
  Uniprot ID: Q8IUD2
  ENSP ID: ENSP00000340054
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 26987 - protein, 1086 aa, Homo sapiens
  Payload ID: 5316
  Gene Symbol: ERC1
  Gene Name: ELKS/RAB6-interacting/CAST family member 1
  ENSP ID: ENSP00000347621
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELERQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQIIQPLLELDQNRSKLKLYIGHLTTLCHDRDPLILRGLTPPASYNLDDDQAAWENELQKMTRGQNPLHPKAMEKLPFFM

SEQ ID NO: 26988 - protein, 1116 aa, Homo sapiens
  Payload ID: 5316
  Gene Symbol: ERC1
  Gene Name: ELKS/RAB6-interacting/CAST family member 1
  Uniprot ID: Q8IUD2
  ENSP ID: ENSP00000354158
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELERQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 26989 - protein, 1088 aa, Homo sapiens
  Payload ID: 5316
  Gene Symbol: ERC1
  Gene Name: ELKS/RAB6-interacting/CAST family member 1
  Uniprot ID: Q8IUD2
  ENSP ID: ENSP00000380386
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELERQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 26990 - protein, 992 aa, Homo sapiens
  Payload ID: 5316
  Gene Symbol: ERC1
  Gene Name: ELKS/RAB6-interacting/CAST family member 1
  Uniprot ID: Q8IUD2
  ENSP ID: ENSP00000410064
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 26991 - protein, 1088 aa, Homo sapiens; identical to SEQ ID NO: 26989
  Payload ID: 5316
  Gene Symbol: ERC1
  Gene Name: ELKS/RAB6-interacting/CAST family member 1
  Uniprot ID: Q8IUD2
  ENSP ID: ENSP00000438546

SEQ ID NO: 26992 - protein, 1120 aa, Homo sapiens
  Payload ID: 5316
  Gene Symbol: ERC1
  Gene Name: ELKS/RAB6-interacting/CAST family member 1
  ENSP ID: ENSP00000442739
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQIIQPLLELDQNRSKLKLYIGHLTTLCHDRDPLILRGLTPPASYNLDDDQAAWENELQKMTRGQLQDELEKGERDNAELQEFANAILQQIADHCPDILEQVVNALEESS

SEQ ID NO: 26993 - protein, 720 aa, Homo sapiens
  Payload ID: 5316
  Gene Symbol: ERC1
  Gene Name: ELKS/RAB6-interacting/CAST family member 1
  Uniprot ID: Q8IUD2
  ENSP ID: ENSP00000442976
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 26994 - protein, 976 aa, Homo sapiens
  Payload ID: 5316
  Gene Symbol: ERC1
  Gene Name: ELKS/RAB6-interacting/CAST family member 1
  ENSP ID: ENSP00000445336
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQARDNTIMDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKVEQLKEELSSKEAQWEELKKKAAGLQAEIGQVKQELSRKDTELLALQTKLETLTNQFSDSKQHIEVLKESLTAKEQRAAILQTEVDALRLRLEEKETMLNKKTKQIQDMAEEKGTQAGEIHDLKDMLDVKERKVNVLQKKIENLQEQLRDKEKQMSSLKERVKSLQADTTNTDTALTTLEEALAEKERTIERLKEQRDRDEREKQEEIDNYKKDLKDLKEKVSLLQGDLSEKEASLLDLKEHASSLASSGLKKDSRLKTLEIALEQKKEECLKMESQLKKAHEAALEARASPEMSDRIQHLEREITRYKDESSKAQAEVDRLLEILKEVENEKNDKDKKIAELESLTSRQVKDQNKKVANLKHKEQVEKKKSAQMLEEARRREDNLNDSSQQLQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 26995 - protein, 145 aa, Homo sapiens
  Payload ID: 5316
  Gene Symbol: ERC1
  Gene Name: ELKS/RAB6-interacting/CAST family member 1
  ENSP ID: ENSP00000464959
MYGSARSVGKVEPSSQSPGRSPRLPRSPRLGHRRTNSTGGSSGSSVGGGSGKTLSMENIQSLNAAYATSGPMYLSDHENVGSETPKSTMTLGRSGGRLPYGVRMTAMGSSPNIASSGVASDTIAFGEHHLPPVSMASTVPHSLRQ

SEQ ID NO: 26996 - protein, 89 aa, Homo sapiens
  Payload ID: 5316
  Gene Symbol: ERC1
  Gene Name: ELKS/RAB6-interacting/CAST family member 1
  ENSP ID: ENSP00000465628
MYGSARSVGKVEPSSQSPGRSPRLPRSPRLGHRRTNSTGGSSGSSVGGGSGKTLSMENIQSLNAAYATSGPMYLSDHENVGSETPKSTM

SEQ ID NO: 26997 - protein, 89 aa, Homo sapiens
  Payload ID: 5316
  Gene Symbol: ERC1
  Gene Name: ELKS/RAB6-interacting/CAST family member 1
  ENSP ID: ENSP00000467196
  MOD_RES (1)..(1): Any amino acid
XHFKSSHSNQTNHKPSPDQIIQPLLELDQNRSKLKLYIGHLTTLCHDRDPLILRGLTPPASYNLDDDQAAWENELQKMTRGQVSLSLKL

SEQ ID NO: 26998 - protein, 285 aa, Homo sapiens
  Payload ID: 5316
  Gene Symbol: ERC1
  Gene Name: ELKS/RAB6-interacting/CAST family member 1
  ENSP ID: ENSP00000467339
  MOD_RES (1)..(1): Any amino acid
XMSDRIQHLEREITRYKDESSKAQAEVDRLLEILKEVENEKNDKDKKIAELERQVKDQNKKVANLKHKEQVEKKKSAQMLEEARRREDNLNDSSQQLQDSLRKKDDRIEELEEALRESVQITAEREMVLAQEESARTNAEKQVEELLMAMEKVKQELESMKAKLSSTQQSLAEKETHLTNLRAERRKHLEEVLEMKQEALLAAISEKDANIALLELSSSKKKTQEEVAALKREKDRLVQQLKQQTQNRMKLMADNYEDDHFKSSHSNQTNHKPSPDQDEEEGIWA

SEQ ID NO: 26999 - protein, 344 aa, Homo sapiens
  Payload ID: 5316
  Gene Symbol: ERC1
  Gene Name: ELKS/RAB6-interacting/CAST family member 1
  ENSP ID: ENSP00000467476
MDLQTQLKEVLRENDLLRKDVEVKESKLSSSMNSIKTFWSPELKKERALRKDEASKITIWKEQYRVVQEENQHMQMTIQALQDELRIQRDLNQLFQQDSSSRTGEPCVAELTEENFQRLHAEHERQAKELFLLRKTLEEMELRIETQKQTLNARDESIKKLLEMLQSKGLSAKATEEDHERTRRLAEAEMHVHHLESLLEQKEKENSMLREEMHRRFENAPDSAKTKALQTVIEMKDSKISSMERGLRDLEEEIQMLKSNGALSTEEREEEMKQMEVYRSHSKFMKNKIGQVKQELSRKDTELLALQTKLETLTNQFSDSKQHIEVLKESLTAKEQRAAILQTE

SEQ ID NO: 27000 - protein, 1116 aa, Homo sapiens; identical to SEQ ID NO: 26988
  Payload ID: 5316
  Gene Symbol: ERC1
  Gene Name: ELKS/RAB6-interacting/CAST family member 1
  Uniprot ID: Q8IUD2
  ENSP ID: ENSP00000468263

SEQ ID NO: 27001 - protein, 720 aa, Homo sapiens; identical to SEQ ID NO: 26993
  Payload ID: 5316
  Gene Symbol: ERC1
  Gene Name: ELKS/RAB6-interacting/CAST family member 1
  Uniprot ID: Q8IUD2
  ENSP ID: ENSP00000479523

SEQ ID NO: 27002 - protein, 957 aa, Homo sapiens
  Payload ID: 5317
  Gene Symbol: ERC2
  Gene Name: ELKS/RAB6-interacting/CAST family member 2
  Uniprot ID: O15083
  ENSP ID: ENSP00000288221
MYGSARTITNLEGSPSRSPRLPRSPRLGHRRTSSGGGGGTGKTLSMENIQSLNAAYATSGPMYLSDHEGVASTTYPKGTMTLGRATNRAVYGGRVTAMGSSPNIASAGLSHTDVLSYTDQHGGLTGSSHHHHHQVPSMLRQVRDSTMLDLQAQLKELQRENDLLRKELDIKDSKLGSSMNSIKTFWSPELKKERVLRKEEAARMSVLKEQMRVSHEENQHLQLTIQALQDELRTQRDLNHLLQQESGNRGAEHFTIELTEENFRRLQAEHDRQAKELFLLRKTLEEMELRIETQKQTLNARDESIKKLLEMLQSKGLPSKSLEDDNERTRRMAEAESQVSHLEVILDQKEKENIHLREELHRRSQLQPEPAKTKALQTVIEMKDTKIASLERNIRDLEDEIQMLKANGVLNTEDREEEIKQIEVYKSHSKFMKTKIDQLKQELSKKESELLALQTKLETLSNQNSDCKQHIEVLKESLTAKEQRAAILQTEVDALRLRLEEKESFLNKKTKQLQDLTEEKGTLAGEIRDMKDMLEVKERKINVLQKKIENLQEQLRDKDKQLTNLKDRVKSLQTDSSNTDTALATLEEALSEKERIIERLKEQRERDDRERLEEIESFRKENKDLKEKVNALQAELTEKESSLIDLKEHASSLASAGLKRDSKLKSLEIAIEQKKEECSKLEAQLKKAHNIEDDSRMNPEFADQIKQLDKEASYYRDECGKAQAEVDRLLEILKEVENEKNDKDKKIAELESLTLRHMKDQNKKVANLKHNQQLEKKKNAQLLEEVRRREDSMADNSQHLQIEELMNALEKTRQELDATKARLASTQQSLAEKEAHLANLRIERRKQLEEILEMKQEALLAAISEKDANIALLELSASKKKKTQEEVMALKREKDRLVHQLKQQTQNRMKLMADNYDDDHHHYHHHHHHHHHRSPGRSQHSNHRPSPDQDDEEGIWA

SEQ ID NO: 27003 - protein, 528 aa, Homo sapiens
  Payload ID: 5317
  Gene Symbol: ERC2
  Gene Name: ELKS/RAB6-interacting/CAST family member 2
  ENSP ID: ENSP00000417280
  MOD_RES (1)..(1): Any amino acid
XRSQLQPEPAKTKALQTVIEMKDTKIASLERNIRDLEDEIQMLKANGVLNTEDREEEIKQIEVYKSHSKFMKTKIDQLKQELSKKESELLALQTKLETLSNQNSDCKQHIEVLKESLTAKEQRAAILQTEVDALRLRLEEKESFLNKKTKQLQDLTEEKGTLAGEIRDMKDMLEVKERKINVLQKKIENLQEQLRDKDKQLTNLKDRVKSLQTDSSNTDTALATLEEALSEKERIIERLKEQRERDDRERLEEIESFRKENKDLKEKVNALQAELTEKESSLIDLKEHASSLASAGLKRDSKLKSLEIAIEQKKEECSKLEAQLKKQAEQLFNQMYNPAHNIEDDSRMNPEFADQIKQLDKEASYYRDECGKAQAEVDRLLEILKEVENEKNDKDKKIAELERHMKDQNKKVANLKHNQQLEKKKNAQLLEEVRRREDSMADNSQHLQIEELMNALEKTRQELDATKARLASTQQSLAEKEAHLANLRIERRKQLEEILEMKQEALLAAISEKDANIALLELSASKKK

SEQ ID NO: 27004 - protein, 957 aa, Homo sapiens; identical to SEQ ID NO: 27002
  Payload ID: 5317
  Gene Symbol: ERC2
  Gene Name: ELKS/RAB6-interacting/CAST family member 2
  Uniprot ID: O15083
  ENSP ID: ENSP00000417445

SEQ ID NO: 27005 - protein, 957 aa, Homo sapiens; identical to SEQ ID NO: 27002
  Payload ID: 5317
  Gene Symbol: ERC2
  Gene Name: ELKS/RAB6-interacting/CAST family member 2
  Uniprot ID: O15083
  ENSP ID: ENSP00000483127

SEQ ID NO: 27006 - protein, 268 aa, Homo sapiens
  Payload ID: 5318
  Gene Symbol: EAF1
  Gene Name: ELL associated factor 1
  Uniprot ID: Q96JC9
  ENSP ID: ENSP00000380054
MNGTANPLLDREEHCLRLGESFEKRPRASFHTIRYDFKPASIDTSCEGELQVGKGDEVTITLPHIPGSTPPMTVFKGNKRPYQKDCVLIINHDTGEYVLEKLSSSIQVKKTRAEGSSKIQARMEQQPTRPPQTSQPPPPPPPMPFRAPTKPPVGPKTSPLKDNPSPEPQLDDIKRELRAEVDIIEQMSSSSGSSSSDSESSSGSDDDSSSSGGEDNGPASPPQPSHQQPYNSRPAVANGTSRPQGSNQLMNTLRNDLQLSESGSDSDD

SEQ ID NO: 27007 - protein, 67 aa, Homo sapiens
  Payload ID: 5318
  Gene Symbol: EAF1
  Gene Name: ELL associated factor 1
  ENSP ID: ENSP00000399636
MNGTANPLLDREEHCLRLGESFEKRPRASFHTIRYDFKPASIDTSCEGELQVGKGDEVTITLPHIPS

SEQ ID NO: 27008 - protein, 260 aa, Homo sapiens
  Payload ID: 5319
  Gene Symbol: EAF2
  Gene Name: ELL associated factor 2
  Uniprot ID: Q96CJ1
  ENSP ID: ENSP00000273668
MNSAAGFSHLDRRERVLKLGESFEKQPRCAFHTVRYDFKPASIDTSSEGYLEVGEGEQVTITLPNIEGSTPPVTVFKGSKKPYLKECILIINHDTGECRLEKLSSNITVKKTRVEGSSKIQYRKEQQQQQMWNSARTPNLVKHSPSEDKMSPASPIDDIERELKAEASLMDQMSSCDSSSDSKSSSSSSSEDSSSDSEDEDCKSSTSDTGNCVSGHPTMTQYRIPDIDASHNRFRDNSGLLMNTLRNDLQLSESGSDSDD

SEQ ID NO: 27009 - protein, 263 aa, Homo sapiens
  Payload ID: 5319
  Gene Symbol: EAF2
  Gene Name: ELL associated factor 2
  ENSP ID: ENSP00000410708
MNSAAGFSHLDRRERVLKLGESFEKQPRCAFHTVRYDFKPASIDTSSEGYLEVGEGEQVTITLPNIEGSTPPVTVFKGSKKPYLKECILIINHDTGECRLEKLSSNITVKKTRVEGSSKIQYRKEQQQQQMWNSARTPNLVKHSPSEDKMSPASPIDDIERELKAEASLMDQMSSCDSSSDSKSSSSSSSEDSSSDSEDEDCKSSTSDTGNCVSGHPTMTQYRIPDIDASHNRFRDNSGLLMNTLNNLSSHSFSSLYDPLLSH

SEQ ID NO: 27010 - protein, 68 aa, Homo sapiens
  Payload ID: 5319
  Gene Symbol: EAF2
  Gene Name: ELL associated factor 2
  ENSP ID: ENSP00000418374
MNSAAGFSHLDRRERVLKLGESFEKQPRCAFHTVRYDFKPASIDTSSEGYLEVGEGEQVTITLPNIES

SEQ ID NO: 27011 - protein, 35 aa, Homo sapiens
  Payload ID: 5319
  Gene Symbol: EAF2
  Gene Name: ELL associated factor 2
  ENSP ID: ENSP00000419552
MNSAAGFSHLDRRERVLKLGESFEKQPRCAFHTVR

SEQ ID NO: 27012 - protein, 992 aa, Homo sapiens
  Payload ID: 5320
  Gene Symbol: EVC
  Gene Name: Ellis van Creveld protein
  Uniprot ID: P57679
  ENSP ID: ENSP00000264956
MARGGAACKSDARLLLGRDALRPAPALLAPAVLLGAALGLGLGLWLGCRAGRQRTRHQKDDTQNLLKNLESNAQTPSETGSPSRRRKREVQMSKDKEAVDECEPPSNSNITAFALKAKVIYPINQKFRPLADGSSNPSLHENLKQAVLPHQPVEASPSSSLGSLSQGEKDDCSSSSSVHSATSDDRFLSRTFLRVNAFPEVLACESVDVDLCIYSLHLKDLLHLDTALRQEKHMMFIQIFKMCLLDLLPKKKSDDELYQKILSKQEKDLEELEKGLQVKLSNTEMSGAGDSEYITLADVEKKEREYSEQLIDNMEAFWKQMANIQHFLVDQFKCSSSKARQLMMTLTERMIAAEGLLCDSQELQALDALERTMGRAHMAKVIEFLKLQVQEETRCRLAAISHGLELLAGEGKLSGRQKEELLTQQHKAFWQEAERFSREFVQRGKDLVTASLAHQVEGTAKLTLAQEEEQRSFLAEAQPTADPEKFLEAFHEVLERQRLMQCDLEEEENVRATEAVVALCQELYFSTVDTFQKFVDALFLQTLPGMTGLPPEECDYLRQEVQENAAWQLGKSNRFRRQQWKLFQELLEQDQQVWMEECALSSVLQTHLREDHEGTIRGVLGRLGGLTEESTRCVLQGHDLLLRSALRRLALRGNALATLTQMRLSGKKHLLQELREQRALEQGSSQCLDEHQWQLLRALEARVLEEASRLEEEAQQTRLQLQQRLLAEAQEVGQLLQQHMECAIGQALLVHARNAATKSRAKDRDDFKRTLMEAAVESVYVTSAGVSRLVQAYYQQIGRIMEDHEERKLQHLKTLQGERMENYKLRKKQELSNPSSGSRTAGGAHETSQAVHQRMLSQQKRFLAQFPVHQQMRLHAQQQQAGVMDLLEAQLETQLQEAEQNFISELAALARVPLAESKLLPAKRGLLEKPLRTKRKKPLPQERGDLGVPNNEDLASGDQTSGSLSSKRLSQQESEAGDSGNSKKMLKRRSNL

SEQ ID NO: 27013 - protein, 535 aa, Homo sapiens
  Payload ID: 5320
  Gene Symbol: EVC
  Gene Name: Ellis van Creveld protein
  ENSP ID: ENSP00000426774
MARGGAACKSDARLLLGRDALRPAPALLAPAVLLGAALGLGLGLWLGCRAGRQRTRHQKDDTQNLLKNLESNAQTPSETGSPSRRRKREVQMSKDKEAVDECEPPSNSNITAFALKAKVIYPINQKFRPLADGSSNPSLHENLKQAVLPHQPVEASPSSSLGSLSQGEKDDCSSSSSVHSATSDDRFLSRTFLRVNAFPEVLACESVDVDLCIYSLHLKDLLHLDTALRQEKHMMFIQIFKMCLLDLLPKKKSDDELYQKILSKQEKDLEELEKGLQVKLSNTEMSGAGDSEYITLADVEKKEREYSEQLIDNMEAFWKQMANIQHFLVDQFKCSSSKARQLMMTLTERMIAAEGLLCDSQELQALDALERTMGRAHMAKVIEFLKLQVQEETRCRLAAISHGLELLAGEGKLSGRQKEELLTQQHKAFWQEAERFSREFVQRGKDLVTASLAHQVEGTAKLTLAQEEEQRSFLAEAQPTADPEKFLEAFHEVLERQRLMQCDLEEEENVRATEAVVALCQKAMRRHRDTGKEAV

SEQ ID NO: 27014 - protein, 1228 aa, Homo sapiens
  Payload ID: 5321
  Gene Symbol: EVC2
  Gene Name: Ellis van Creveld syndrome 2
  Uniprot ID: Q86UK5
  ENSP ID: ENSP00000311683
MIWPKVECCHFKTAVEAPLGMKLDKKMEVFIPLSTSAASSGPWAHSLFAFIPSWPKKNLFKRESPITHRLYGDISREVQGTSENGVIFQKCALVSGSSEAQTARIWLLVNNTKTTSSANLSELLLLDSIAGLTIWDSVGNRTSEGFQAFSKKFLQVGDAFAVSYAATLQAGDLGNGESLKLPAQLTFQSSSRNRTQLKVLFSITAEENVTVLPHHGLHAAGFFIAFLLSLVLTWAALFLMVRYQCLKGNMLTRHRVWQYESKLEPLPFTSADGVNEDLSLNDQMIDILSSEDPGSMLQALEELEIATLNRADADLEACRTQISKDIIALLLKNLTSSGHLSPQVERKMSAVFKKQFLLLENEIQEEYDRKMVALTAECDLETRKKMENQYQREMMAMEEAEELLKRAGERSAVECSNLLRTLHGLEQEHLRKSLALQQEEDFAKAHRQLAVFQRNELHSIFFTQIKSAIFKGELKPEAAKMLLQNYSKIQENVEELMDFFQASKRYHLSKRFGHREYLVQNLQSSETRVQGLLSTAAAQLTHLIQKHERAGYLDEDQMEMLLERAQTEVFSIKQKLDNDLKQEKKKLHQKLITKRRRELLQKHREQRREQASVGEAFRTVEDAGQYLHQKRSLMEEHGATLEELQERLDQAALDDLRTLTLSLFEKATDELRRLQNSAMTQELLKRGVPWLFLQQILEEHGKEMAARAEQLEGEERDRDQEGVQSVRQRLKDDAPEAVTEEQAELRRWEHLIFMKLCSSVFSLSEEELLRMRQEVHGCFAQMDRSLALPKIRARVLLQQFQTAWREAEFVKLDQAVAAPELQQQSKVRKSRSKSKSKGELLKKCIEDKIHLCEEQASEDLVEKVRGELLRERVQRMEAQEGGFAQSLVALQFQKASRVTETLSAYTALLSIQDLLLEELSASEMLTKSACTQILESHSRELQELERKLEDQLVQQEAAQQQQALASWQQWVADGPGILNEPGEVDSERQVSTVLHQALSKSQTLLEQHQQCLREEQQNSVVLEDLLENMEADTFATLCSQELRLASYLARMAMVPGATLRRLLSVVLPTASQPQLLALLDSATERHVDHAAESDGGAEQADVGRRRKHQSWWQALDGKLRGDLISRGLEKMLWARKRKQSILKKTCLPLRERMIFSGKGSWPHLSLEPIGELAPVPIVGAETIDLLNTGEKLFIFRNPKEPEISLHVPPRKKKNFLNAKKAMRALGMD

SEQ ID NO: 27015 - protein, 1308 aa, Homo sapiens
  Payload ID: 5321
  Gene Symbol: EVC2
  Gene Name: Ellis van Creveld syndrome 2
  Uniprot ID: Q86UK5
  ENSP ID: ENSP00000342144
MDPSGSRGRPTWVLAGGLLAVALALGGRGCLGASSRPRWRPLGAQPPRDPQVAPRSGPGLRIPPGRSGAGPESSTQDLPCMIWPKVECCHFKTAVEAPLGMKLDKKMEVFIPLSTSAASSGPWAHSLFAFIPSWPKKNLFKRESPITHRLYGDISREVQGTSENGVIFQKCALVSGSSEAQTARIWLLVNNTKTTSSANLSELLLLDSIAGLTIWDSVGNRTSEGFQAFSKKFLQVGDAFAVSYAATLQAGDLGNGESLKLPAQLTFQSSSRNRTQLKVLFSITAEENVTVLPHHGLHAAGFFIAFLLSLVLTWAALFLMVRYQCLKGNMLTRHRVWQYESKLEPLPFTSADGVNEDLSLNDQMIDILSSEDPGSMLQALEELEIATLNRADADLEACRTQISKDIIALLLKNLTSSGHLSPQVERKMSAVFKKQFLLLENEIQEEYDRKMVALTAECDLETRKKMENQYQREMMAMEEAEELLKRAGERSAVECSNLLRTLHGLEQEHLRKSLALQQEEDFAKAHRQLAVFQRNELHSIFFTQIKSAIFKGELKPEAAKMLLQNYSKIQENVEELMDFFQASKRYHLSKRFGHREYLVQNLQSSETRVQGLLSTAAAQLTHLIQKHERAGYLDEDQMEMLLERAQTEVFSIKQKLDNDLKQEKKKLHQKLITKRRRELLQKHREQRREQASVGEAFRTVEDAGQYLHQKRSLMEEHGATLEELQERLDQAALDDLRTLTLSLFEKATDELRRLQNSAMTQELLKRGVPWLFLQQILEEHGKEMAARAEQLEGEERDRDQEGVQSVRQRLKDDAPEAVTEEQAELRRWEHLIFMKLCSSVFSLSEEELLRMRQEVHGCFAQMDRSLALPKIRARVLLQQFQTAWREAEFVKLDQAVAAPELQQQSKVRKSRSKSKSKGELLKKCIEDKIHLCEEQASEDLVEKVRGELLRERVQRMEAQEGGFAQSLVALQFQKASRVTETLSAYTALLSIQDLLLEELSASEMLTKSACTQILESHSRELQELERKLEDQLVQQEAAQQQQALASWQQWVADGPGILNEPGEVDSERQVSTVLHQALSKSQTLLEQHQQCLREEQQNSVVLEDLLENMEADTFATLCSQELRLASYLARMAMVPGATLRRLLSVVLPTASQPQLLALLDSATERHVDHAAESDGGAEQADVGRRRKHQSWWQALDGKLRGDLISRGLEKMLWARKRKQSILKKTCLPLRERMIFSGKGSWPHLSLEPIGELAPVPIVGAETIDLLNTGEKLFIFRNPKEPEISLHVPPRKKKNFLNAKKAMRALGMD

SEQ ID NO: 27016 - protein, 452 aa, Homo sapiens
  Payload ID: 5321
  Gene Symbol: EVC2
  Gene Name: Ellis van Creveld syndrome 2
  ENSP ID: ENSP00000423876
MIWPKVECCHFKTAVEAPLGMKLDKKMEVFIPLSTSAASSGPWAHSLFAFIPSWPKKNLFKRESPITHRLYGDISREVQGTSENGVIFQKCALVSGSSEAQTARIWLLVNNTKTTSSANLSELLLLDSIAGLTIWDSVGNRTSEGFQAFSKKFLQVGDAFAVSYAATLQAGDLGNGESLKLPAQLTFQSSSRNRTQLKVLFSITAEENVTVLPHHGLHAAGFFIAFLLSLVLTWAALFLMVRYQCLKGNMLTRHRVWQYESKLEPLPFTSADGVNEDLSLNDQMIDILSSEDPGSMLQALEELEIATLNRADADLEACRTQISKDIIALLLKNLTSSGHLSPQVERKMSAVFKKQFLLLENEIQEEYDRKMVALTAECDLETRKKMENQYQREMMAMEEAEELLKRAVCCRVQQPSADPPWPGTGALEEVSRFATRRRLCQSSQTAGCFPEK

SEQ ID NO: 27017 - protein, 1166 aa, Homo sapiens
  Payload ID: 5321
  Gene Symbol: EVC2
  Gene Name: Ellis van Creveld syndrome 2
  ENSP ID: ENSP00000431981
MIWPKVECCHFKTAVEAPLGMKLDKKMEVFIPLSTSAASSGPWAHSLFAFIPSWPKKNLFKRESPITHRLYGDISREVQGTSENGVIFQKCALVSGSSEAQTARIWLLVNNTKTTSSANLSELLLLDSIAGLTIWDSVGNRTSEGFQAFSKKFLQVGDAFAVSYAATLQAGDLGNGESLKLPAQLTFQSSSRNRTQLKVLFSITAEENVTVLPHHGLHAAGFFIAFLLSLVLTWAALFLMVRYQCLKGNMLTRHRVWQYESKLEPLPFTSADGVNEDLSLNDQMIDILSSEDPGSMLQALEELEIATLNRADADLEACRTQISKDIIALLLKNLTSSGHLSPQVERKMSAVFKKQFLLLENEIQEEYDRKMVALTAECDLETRKKMENQYQREMMAMEEAEELLKRAGERSAVECSNLLRTLHGLEQEHLRKSLALQQEEDFAKAHRQLAVFQRNELHSIFFTQIKSAIFKGELKPEAAKMLLQNYSKIQENVEELMDFFQASKRYHLSKRFGHREYLVQNLQSSETRVQGLLSTAAAQLTHLIQKHERAGYLDEDQMEMLLERAQTEVFSIKQKLDNDLKQEKKKLHQKLITKRRRELLQKHREQRREQASVGEAFRTVEDAGQYLHQKRSLMEEHGATLEELQERLDQAALDDLRTLTLSLFEKATDELRRLQNSAMTQELLKRGVPWLFLQQILEEHGKEMAARAEQLEGEERDRDQEGVQSVRQRLKDDAPEAVTEEQAELRRWEHLIFMKLCSSVFSLSEEELLRMRQEVHGCFAQMDRSLALPKIRARVLLQQFQTAWREAEFVKLDQAVAAPELQQQSKVRKSRSKSKSKGELLKKCIEDKIHLCEEQASEDLVEKVRGELLRERVQRMEAQEGGFAQSLVALQFQKASRVTETLSAYTALLSIQDLLLEELSASEMLTKSACTQILESHSRELQELERKLEDQLVQQEAAQQQQALASWQQWVADGPGILNEPGEVDSERQVSTVLHQALSKSQTLLEQHQQCLREEQQNSVVLEDLLENMEADTFATLCSQELRLASYLARMAMVPGATLRRLLSVVLPTASQPQLLALLDSATERHVDHAAESDGGAEQADVGRRRKHQSWWQALDGKLRGDLISRGLEKMLWARKRKQRSGNQESFWQYLVGTPEIGLIEWMSEK

SEQ ID NO: 27018 - protein, 1045 aa, Homo sapiens
  Payload ID: 5322
  Gene Symbol: ELMSAN1
  Gene Name: ELM2 and Myb/SANT-like domain containing 1
  Uniprot ID: Q6PJG2
  ENSP ID: ENSP00000286523
MNLQAQPKAQNKRKRCLFGGQEPAPKEQPPPLQPPQQSIRVKEEQYLGHEGPGGAVSTSQPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQAEDMNVKLEGEPSVRKPKQRPRPEPLIIPTKAGTFIAPPVYSNITPYQSHLRSPVRLADHPSERSFELPPYTPPPILSPVREGSGLYFNAIISTSTIPAPPPITPKSAHRTLLRTNSAEVTPPVLSVMGEATPVSIEPRINVGSRFQAEIPLMRDRALAAADPHKADLVWQPWEDLESSREKQRQVEDLLTAACSSIFPGAGTNQELALHCLHESRGDILETLNKLLLKKPLRPHNHPLATYHYTGSDQWKMAERKLFNKGIAIYKKDFFLVQKLIQTKTVAQCVEFYYTYKKQVKIGRNGTLTFGDVDTSDEKSAQEEVEVDIKTSQKFPRVPLPRRESPSEERLEPKREVKEPRKEGEEEVPEIQEKEEQEEGRERSRRAAAVKATQTLQANESASDILILRSHESNAPGSAGGQASEKPREGTGKSRRALPFSEKKKKTETFSKTQNQENTFPCKKCGR

SEQ ID NO: 27019 - protein, 1045 aa, Homo sapiens; identical to SEQ ID NO: 27018
  Payload ID: 5322
  Gene Symbol: ELMSAN1
  Gene Name: ELM2 and Myb/SANT-like domain containing 1
  Uniprot ID: Q6PJG2
  ENSP ID: ENSP00000377634

SEQ ID NO: 27020 - protein, 445 aa, Homo sapiens
  Payload ID: 5322
  Gene Symbol: ELMSAN1
  Gene Name: ELM2 and Myb/SANT-like domain containing 1
  ENSP ID: ENSP00000400871
VRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQKKFADFCPRGDDKKGFWTCSFFQACLGGCGRQTKFQRQRT

SEQ ID NO: 27021 - protein, 65 aa, Homo sapiens
  Payload ID: 5322
  Gene Symbol: ELMSAN1
  Gene Name: ELM2 and Myb/SANT-like domain containing 1
  ENSP ID: ENSP00000401344
MNLQAQPKAQNKRKRCLFGGQEPAPKEQPPPLQPPQQSIRVKEEQYLGHEGPGGAVSTSQPVELP

SEQ ID NO: 27022 - protein, 1018 aa, Homo sapiens
  Payload ID: 5322
  Gene Symbol: ELMSAN1
  Gene Name: ELM2 and Myb/SANT-like domain containing 1
  ENSP ID: ENSP00000402380
MNLQAQPKAQNKRKRCLFGGQEPAPKEQPPPLQPPQQSIRVKEEQYLGHEGPGGAVSTSQPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQQQQQQQQAALPQMPLFENFYSMPQQPSQQPQDFGLQPAGPLGQSHLAHHSMAPYPFPPNPDMNPELRKALLQDSAPQPALPQVQIPFPRRSRRLSKEGILPPSALDGAGTQPGQEATGNLFLHHWPLQQPPPGSLGQPHPEALGFPLELRESQLLPDGERLAPNGREREAPAMGSEEGMRAVSTGDCGQVLRGGVIQSTRRRRRASQEANLLTLAQKAVELASLQNAKDGSGSEEKRKSVLASTTKCGVEFSEPSLATKRAREDSGMVPLIIPVSVPVRTVDPTEAAQAGGLDEDGKGPEQNPAEHKPSVIVTRRRSTRIPGTDAQAQAEDMNVKLEGEPSVRKPKQRPRPEPLIIPTKAGTFIAPPVYSNITPYQSHLRSPVRLADHPSERSFELPPYTPPPILSPVREGSGLYFNAIISTSTIPAPPPITPKSAHRTLLRTNSAEVTPPVLSVMGEATPVSIEPRINVGSRFQAEIPLMRDRALAAADPHKADLVWQPWEDLESSREKQRQVEDLLTAACSSIFPGAGTNQELALHCLHESRGDILETLNKLLLKKPLRPHNHPLATYHYTGSDQWKMAERKLFNKGIAIYKKDFFLVQKLIQTKTVAQCVEFYYTYKKQVKIGRNGTLTFGDVDTSDEKSAQEEVEVDIKTSQKFPRVPLPRRESPSEERLEPKREVKEPRKEGEEEVPEIQEKEEQEEGRERSRRAAAVKATQTLQANESASDILILRSHESNAPGSAGGQASEKPREGTGKSRRALPF

SEQ ID NO: 27023 - protein, 1045 aa, Homo sapiens; identical to SEQ ID NO: 27018
  Payload ID: 5322
  Gene Symbol: ELMSAN1
  Gene Name: ELM2 and Myb/SANT-like domain containing 1
  Uniprot ID: Q6PJG2
  ENSP ID: ENSP00000407767

SEQ ID NO: 27024 - protein, 334 aa, Homo sapiens
  Payload ID: 5323
  Gene Symbol: ELMOD1
  Gene Name: ELMO/CED-12 domain containing 1
  Uniprot ID: Q8N336
  ENSP ID: ENSP00000265840
MKHFLRMLIQVCLYFYCKFLWRCLKFVMRKLTGRCELQRICYNTKPGASRTMKIETSLRDSKSKLLQTSVSVHPDAIEKTIEDIMELKKINPDVNPQLGISLQACLLQIVGYRNLIADVEKLRREAYDSDNPQHEEMLLKLWKFLKPNTPLESRISKQWCEIGFQGDDPKTDFRGMGLLGLYNLQYFAERDATAAQQVLSDSLHPKCRDITKEEISKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 27025 - protein, 326 aa, Homo sapiens
  Payload ID: 5323
  Gene Symbol: ELMOD1
  Gene Name: ELMO/CED-12 domain containing 1
  Uniprot ID: Q8N336
  ENSP ID: ENSP00000412257
MKHFLRMLIQVCLYFYCKFLWRCLKFVMRKLTGRCELQRICYNTKPGASRTMKIETSLRDSKSKLLQTSVSVHPDAIEKTIEDIMELKKINPDVNPQLGISLQACLLQIVGYRNLIADVEKLRREAYDSDNPQHEEMLLKLWKFLKPNTPLESRISKQWCEIGFQGDDPKTDFRGMGLLGLYNLQYFAERDATAAQQVLSDSLHPKCSKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 27026 - protein, 328 aa, Homo sapiens
  Payload ID: 5323
  Gene Symbol: ELMOD1
  Gene Name: ELMO/CED-12 domain containing 1
  ENSP ID: ENSP00000433232
MLIQVCLYFYCKFLWRCLKFVMRKLTGRCELQRICYNTKPGASRTMKIETSLRDSKSKLLQTSVSVHPDAIEKTIEDIMELKKINPDVNPQLGISLQACLLQIVGYRNLIADVEKLRREAYDSDNPQHEEMLLKLWKFLKPNTPLESRISKQWCEIGFQGDDPKTDFRGMGLLGLYNLQYFAERDATAAQQVLSDSLHPKCRDITKEEISKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 27027 - protein, 293 aa, Homo sapiens
  Payload ID: 5324
  Gene Symbol: ELMOD2
  Gene Name: ELMO/CED-12 domain containing 2
  Uniprot ID: Q8IZ81
  ENSP ID: ENSP00000326342
MFISLWEFFYGHFFRFWMKWLLRQMTGKCELQRIFDTYVGAQRTHRIENSLTYSKNKVLQKATHVVQSEVDKYVDDIMKEKNINPEKDASFKICMKMCLLQITGYKQLYLDVESVRKRPYDSDNLQHEELLMKLWNLLMPTKKLNARISKQWAEIGFQGDDPKTDFRGMGILGLINLVYFSENYTSEAHQILSRSNHPKLGYSYAIVGINLTEMAYSLLKSEALKFHLYNLVPGIPTMEHFHQFYCYLVYEFDKFWFEEEPESIMYFNLYREKFHEKIKGLLLDCNVALTLKV

SEQ ID NO: 27028 - protein, 167 aa, Homo sapiens
  Payload ID: 5324
  Gene Symbol: ELMOD2
  Gene Name: ELMO/CED-12 domain containing 2
  ENSP ID: ENSP00000422582
MFISLWEFFYGHFFRFWMKWLLRQMTGKCELQRIFDTYVGAQRTHRIENSLTYSKNKVLQKATHVVQSEVDKYVDDIMKEKNINPEKDASFKICMKMCLLQITGYKQLYLDVESVRKRPYDSDNLQHEELLMKLWNLLMPTKKLNARISKQWAEIGFQGDDPKTDFR

SEQ ID NO: 27029 - protein, 35 aa, Homo sapiens
  Payload ID: 5324
  Gene Symbol: ELMOD2
  Gene Name: ELMO/CED-12 domain containing 2
  ENSP ID: ENSP00000427265
MFISLWEFFYGHFFRFWMKWLLRQMTGKCELQRIF

SEQ ID NO: 27030 - protein, 96 aa, Homo sapiens
  Payload ID: 5324
  Gene Symbol: ELMOD2
  Gene Name: ELMO/CED-12 domain containing 2
  ENSP ID: ENSP00000427592
MKEKNINPEKDASFKICMKMCLLQITGYKQLYLDVESVRKRPYDSDNLQHEELLMKLWNLLMPTKKLNARISKQWAEIGFQGDDPKTDFRGMGILG

SEQ ID NO: 27031 - protein, 59 aa, Homo sapiens
  Payload ID: 5324
  Gene Symbol: ELMOD2
  Gene Name: ELMO/CED-12 domain containing 2
  ENSP ID: ENSP00000476419
MFISLWEFFYGHFFRFWMKWLLRQMTGKCELQRIFDTYVGAQRTHRIENSLTYSKNKVG

SEQ ID NO: 27032 - protein, 391 aa, Homo sapiens
  Payload ID: 5325
  Gene Symbol: ELMOD3
  Gene Name: ELMO/CED-12 domain containing 3
  Uniprot ID: Q96FG2
  ENSP ID: ENSP00000318264
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQGANPATDLRGAGFLALLHLLYLVMDSKTLPMAQEIFRLSRHHIQQFPFCLMSVNITHIAIQALREECLSRECNRQQKVIPVVNSFYAATFLHLAHVWRTQRKTISDSGFVLKGVLFLLGRPRLNAQCPRSREPKVVARLVLAAVLPHPHFLKFQLTKISITHPLESASSPFSALTVALFWSYTYDKHIF

SEQ ID NO: 27033 - protein, 381 aa, Homo sapiens
  Payload ID: 5325
  Gene Symbol: ELMOD3
  Gene Name: ELMO/CED-12 domain containing 3
  Uniprot ID: Q96FG2
  ENSP ID: ENSP00000377434
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQGANPATDLRGAGFLALLHLLYLVMDSKTLPMAQEIFRLSRHHIQQFPFCLMSVNITHIAIQALREECLSRECNRQQKVIPVVNSFYAATFLHLAHVWRTQRKTISDSGFVLKELEVLAKKSPRRLLKTLELYLARVSKGQASLLGAQKCYGPEAPPFKDLTFTGESDLQSHSSEGVWLI

SEQ ID NO: 27034 - protein, 381 aa, Homo sapiens; identical to SEQ ID NO: 27033
  Payload ID: 5325
  Gene Symbol: ELMOD3
  Gene Name: ELMO/CED-12 domain containing 3
  Uniprot ID: Q96FG2
  ENSP ID: ENSP00000386248

SEQ ID NO: 27035 - protein, 202 aa, Homo sapiens
  Payload ID: 5325
  Gene Symbol: ELMOD3
  Gene Name: ELMO/CED-12 domain containing 3
  ENSP ID: ENSP00000386257
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQ

SEQ ID NO: 27036 - protein, 381 aa, Homo sapiens; identical to SEQ ID NO: 27033
  Payload ID: 5325
  Gene Symbol: ELMOD3
  Gene Name: ELMO/CED-12 domain containing 3
  Uniprot ID: Q96FG2
  ENSP ID: ENSP00000386304

SEQ ID NO: 27037 - protein, 185 aa, Homo sapiens
  Payload ID: 5325
  Gene Symbol: ELMOD3
  Gene Name: ELMO/CED-12 domain containing 3
  Uniprot ID: Q96FG2
  ENSP ID: ENSP00000387134
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCECNASPQGSCCICGWARPCVLTL

SEQ ID NO: 27038 - protein, 381 aa, Homo sapiens; identical to SEQ ID NO: 27033
  Payload ID: 5325
  Gene Symbol: ELMOD3
  Gene Name: ELMO/CED-12 domain containing 3
  Uniprot ID: Q96FG2
  ENSP ID: ENSP00000387139

SEQ ID NO: 27039 - protein, 120 aa, Homo sapiens
  Payload ID: 5325
  Gene Symbol: ELMOD3
  Gene Name: ELMO/CED-12 domain containing 3
  ENSP ID: ENSP00000393443
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFK

SEQ ID NO: 27040 - protein, 161 aa, Homo sapiens
  Payload ID: 5325
  Gene Symbol: ELMOD3
  Gene Name: ELMO/CED-12 domain containing 3
  Uniprot ID: Q96FG2
  ENSP ID: ENSP00000394774
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQ

SEQ ID NO: 27041 - protein, 44 aa, Homo sapiens
  Payload ID: 5325
  Gene Symbol: ELMOD3
  Gene Name: ELMO/CED-12 domain containing 3
  ENSP ID: ENSP00000398264
MNEKSCSFHSKEELRDGQGERLSAGYSPSYDKDKSVLAFRGIPL

SEQ ID NO: 27042 - protein, 254 aa, Homo sapiens
  Payload ID: 5325
  Gene Symbol: ELMOD3
  Gene Name: ELMO/CED-12 domain containing 3
  Uniprot ID: Q96FG2
  ENSP ID: ENSP00000401984
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQGANPATDLRGAGFLALLHLLYLVMDSKTLPMAQEIFRLSRHHIQIERNQGKG

SEQ ID NO: 27043 - protein, 254 aa, Homo sapiens; identical to SEQ ID NO: 27042
  Payload ID: 5325
  Gene Symbol: ELMOD3
  Gene Name: ELMO/CED-12 domain containing 3
  Uniprot ID: Q96FG2
  ENSP ID: ENSP00000407599

SEQ ID NO: 27044 - protein, 84 aa, Homo sapiens
  Payload ID: 5325
  Gene Symbol: ELMOD3
  Gene Name: ELMO/CED-12 domain containing 3
  ENSP ID: ENSP00000408329
MNEKSCSFHSKEELRDGQGERLSAGYSPSYDKDKSVLAFRGIPKRIQPTIRRTGLAALRHYLFGPPKLHQRLREERDLVLTIAQ

SEQ ID NO: 27045 - protein, 162 aa, Homo sapiens
  Payload ID: 5325
  Gene Symbol: ELMOD3
  Gene Name: ELMO/CED-12 domain containing 3
  ENSP ID: ENSP00000408745
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQY

SEQ ID NO: 27046 - protein, 126 aa, Homo sapiens
  Payload ID: 5325
  Gene Symbol: ELMOD3
  Gene Name: ELMO/CED-12 domain containing 3
  ENSP ID: ENSP00000436715
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPT

SEQ ID NO: 27047 - protein, 621 aa, Homo sapiens
  Payload ID: 5326
  Gene Symbol: ELL
  Gene Name: elongation factor RNA polymerase II
  Uniprot ID: P55199
  ENSP ID: ENSP00000262809
MAALKEDRSYGLSCGRVSDGSKVSVFHVKLTDSALRAFESYRARQDSVSLRPSIRFQGSQGHISIPQPDCPAEARTFSFYLSNIGRDNPQGSFDCIQQYVSSHGEVHLDCLGSIQDKITVCATDDSYQKARQSMAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVANMSAKDGTCTLQDCMYKDVQKDWPGYSEGDQQLLKRVLVRKLCQPQSTGSLLGDPAASSPPGERGRSASPPQKRLQPPDFIDPLANKKPRISHFTQRAQPAVNGKLGVPNGREALLPTPGPPASTDTLSSSTHLPPRLEPPRAHDPLADVSNDLGHSGRDCEHGEAAAPAPTVRLGLPLLTDCAQPSRPHGSPSRSKPKKKSKKHKDKERAAEDKPRAQLPDCAPATHATPGAPADTPGLNGTCSVSSVPTSTSETPDYLLKYAAISSSEQRQSYKNDFNAEYSEYRDLHARIERITRRFTQLDAQLRQLSQGSEEYETTRGQILQEYRKIKKTNTNYSQEKHRCEYLHSKLAHIKRLIAEYDQRQLQAWP

SEQ ID NO: 27048 - protein, 488 aa, Homo sapiens
  Payload ID: 5326
  Gene Symbol: ELL
  Gene Name: elongation factor RNA polymerase II
  ENSP ID: ENSP00000475648
MAQAEEETRSRSAIVIKAGGRYLGKKVQFRKPAPGATDAVPSRKRATPINLASAIRKSGASAVSGGSGVSQRPFRDRVLHLLALRPYRKAELLLRLQKDGLTQADKDALDGLLQQVANMSAKDGTCTLQDCMYKDVQKDWPGYSEGDQQLLKRVLVRKLCQPQSTGSLLGDPAASSPPGERGRSASPPQKRLQPPDFIDPLANKKPRISHFTQRAQPAVNGKLGVPNGREALLPTPGPPASTDTLSSSTHLPPRLEPPRAHDPLADVSNDLGHSGRDCEHGEAAAPAPTVRLGLPLLTDCAQPSRPHGSPSRSKPKKKSKKHKDKERAAEDKPRAQLPDCAPATHATPGAPADTPGLNGTCSVSSVPTSTSETPDYLLKYAAISSSEQRQSYKNDFNAEYSEYRDLHARIERITRRFTQLDAQLRQLSQGSEEYETTRGQILQEYRKIKKTNTNYSQEKHRCEYLHSKLAHIKRLIAEYDQRQLQAWP

SEQ ID NO: 27049 - protein, 74 aa, Homo sapiens
  Payload ID: 5326
  Gene Symbol: ELL
  Gene Name: elongation factor RNA polymerase II
  ENSP ID: ENSP00000475681
MAALKEDRSYGLSCGRVSDGSKVSVFHVKLTDSALRAFESYRARQDSVSLRPSIRFQGSQGPESSAQLDVGIWT

SEQ ID NO: 27050 - protein, 397 aa, Homo sapiens
  Payload ID: 5327
  Gene Symbol: ELL3
  Gene Name: elongation factor RNA polymerase II-like 3
  Uniprot ID: Q9HB65
  ENSP ID: ENSP00000320346
MEELQEPLRGQLRLCFTQAARTSLLLLRLNDAALRALQECQRQQVRPVIAFQGHRGYLRLPGPGWSCLFSFIVSQCCQEGAGGSLDLVCQRFLRSGPNSLHCLGSLRERLIIWAAMDSIPAPSSVQGHNLTEDARHPESWQNTGGYSEGDAVSQPQMALEEVSVSDPLASNQGQSLPGSSREHMAQWEVRSQTHVPNREPVQALPSSASRKRLDKKRSVPVATVELEEKRFRTLPLVPSPLQGLTNQDLQEGEDWEQEDEDMDPRLEHSSSVQEDSESPSPEDIPDYLLQYRAIHSAEQQHAYEQDFETDYAEYRILHARVGTASQRFIELGAEIKRVRRGTPEYKVLEDKIIQEYKKFRKQYPSYREEKRRCEYLHQKLSHIKGLILEFEEKNRGS

SEQ ID NO: 27051 - protein, 206 aa, Homo sapiens
  Payload ID: 5327
  Gene Symbol: ELL3
  Gene Name: elongation factor RNA polymerase II-like 3
  ENSP ID: ENSP00000404209
MRILEESAERRWRWWPSPVAPVLLALELVAMEELQEPLRGQLRLCFTQAARTSLLLLRLNDAALRALQECQRQQVRPVIAFQGHRGYLRLPGPGWSCLFSFIVSQCCQEGAGGSLDLVCQRFLRSGPNSLHCLGSLRERLIIWAAMDSIPAPSSVQGHNLTEDARHPESWQNTGGYSEGDAVSQPQMALEEVSVSDPLASNQGQSL

SEQ ID NO: 27052 - protein, 1120 aa, Homo sapiens
  Payload ID: 5328
  Gene Symbol: EFTUD1
  Gene Name: elongation factor Tu GTP binding domain containing 1
  Uniprot ID: Q7Z2Z2
  ENSP ID: ENSP00000268206
MVLNSLDKMIQLQKNTANIRNICVLAHVDHGKTTLADCLISSNGIISSRLAGKLRYMDSREDEQIRGITMKSSAISLHYATGNEEYLINLIDSPGHVDFSSEVSTAVRICDGCIIVVDAVEGVCPQTQAVLRQAWLENIRPVLVINKIDRLIVELKFTPQEAYSHLKNILEQINALTGTLFTSKVLEERAERETESQVNPNSEQGEQVYDWSTGLEDTDDSHLYFSPEQGNVVFTSAIDGWGFGIEHFARIYSQKIGIKKEVLMKTLWGDYYINMKAKKIMKGDQAKGKKPLFVQLILENIWSLYDAVLKKDKDKIDKIVTSLGLKIGAREARHSDPKVQINAICSQWLPISHAVLAMVCQKLPSPLDITAERVERLMCTGSQTFDSFPPETQALKAAFMKCGSEDTAPVIIFVSKMFAVDAKALPQNKPRPLTQEEIAQRRERARQRHAEKLAAAQGQAPLEPTQDGSAIETCPKGEEPRGDEQQVESMTPKPVLQEENNQESFIAFARVFSGVARRGKKIFVLGPKYSPLEFLRRVPLGFSAPPDGLPQVPHMAYCALENLYLLMGRELEYLEEVPPGNVLGIGGLQDFVLKSATLCSLPSCPPFIPLNFEATPIVRVAVEPKHPSEMPQLVKGMKLLNQADPCVQILIQETGEHVLVTAGEVHLQRCLDDLKERFAKIHISVSEPIIPFRETITKPPKVDMVNEEIGKQQKVAVIHQMKEDQSKIPEGIQVDSDGLITITTPNKLATLSVRAMPLPEEVTQILEENSDLIRSMEQLTSSLNEGENTHMIHQKTQEKIWEFKGKLEQHLTGRRWRNIVDQIWSFGPRKCGPNILVNKSEDFQNSVWTGPADKASKEASRYRDLGNSIVSGFQLATLSGPMCEEPLMGVCFVLEKWDLSKFEEQGASDLAKEGQEENETCSGGNENQELQDGCSEAFEKRTSQKGESPLTDCYGPFSGQLIATMKEACRYALQVKPQRLMAAMYTCDIMATGDVLGRVYAVLSKREGRVLQEEMKEGTDMFIIKAVLPVAESFGFADEIRKRTSGLASPQLVFSHWEIIPSDPFWVPTTEEEYLHFGEKADSENQARKYMNAVRKRKGLYVEEKIVEHAEKQRTLSKNK

SEQ ID NO: 27053 - protein, 1069 aa, Homo sapiens
  Payload ID: 5328
  Gene Symbol: EFTUD1
  Gene Name: elongation factor Tu GTP binding domain containing 1
  Uniprot ID: Q7Z2Z2
  ENSP ID: ENSP00000352418
MVLNSLDKMIQLQKNTANIRNICVLAHVDHGNEEYLINLIDSPGHVDFSSEVSTAVRICDGCIIVVDAVEGVCPQTQAVLRQAWLENIRPVLVINKIDRLIVELKFTPQEAYSHLKNILEQINALTGTLFTSKVLEERAERETESQVNPNSEQGEQVYDWSTGLEDTDDSHLYFSPEQGNVVFTSAIDGWGFGIEHFARIYSQKIGIKKEVLMKTLWGDYYINMKAKKIMKGDQAKGKKPLFVQLILENIWSLYDAVLKKDKDKIDKIVTSLGLKIGAREARHSDPKVQINAICSQWLPISHAVLAMVCQKLPSPLDITAERVERLMCTGSQTFDSFPPETQALKAAFMKCGSEDTAPVIIFVSKMFAVDAKALPQNKPRPLTQEEIAQRRERARQRHAEKLAAAQGQAPLEPTQDGSAIETCPKGEEPRGDEQQVESMTPKPVLQEENNQESFIAFARVFSGVARRGKKIFVLGPKYSPLEFLRRVPLGFSAPPDGLPQVPHMAYCALENLYLLMGRELEYLEEVPPGNVLGIGGLQDFVLKSATLCSLPSCPPFIPLNFEATPIVRVAVEPKHPSEMPQLVKGMKLLNQADPCVQILIQETGEHVLVTAGEVHLQRCLDDLKERFAKIHISVSEPIIPFRETITKPPKVDMVNEEIGKQQKVAVIHQMKEDQSKIPEGIQVDSDGLITITTPNKLATLSVRAMPLPEEVTQILEENSDLIRSMEQLTSSLNEGENTHMIHQKTQEKIWEFKGKLEQHLTGRRWRNIVDQIWSFGPRKCGPNILVNKSEDFQNSVWTGPADKASKEASRYRDLGNSIVSGFQLATLSGPMCEEPLMGVCFVLEKWDLSKFEEQGASDLAKEGQEENETCSGGNENQELQDGCSEAFEKRTSQKGESPLTDCYGPFSGQLIATMKEACRYALQVKPQRLMAAMYTCDIMATGDVLGRVYAVLSKREGRVLQEEMKEGTDMFIIKAVLPVAESFGFADEIRKRTSGLASPQLVFSHWEIIPSDPFWVPTTEEEYLHFGEKADSENQARKYMNAVRKRKGLYVEEKIVEHAEKQRTLSKNK

SEQ ID NO: 27054 - protein, 58 aa, Homo sapiens
  Payload ID: 5328
  Gene Symbol: EFTUD1
  Gene Name: elongation factor Tu GTP binding domain containing 1
  ENSP ID: ENSP00000452687
MVLNSLDKMIQLQKNTANIRNICVLAHVDHGKTTLADCLISSNGIISSRLAGKVMRST

SEQ ID NO: 27055 - protein, 139 aa, Homo sapiens
  Payload ID: 5328
  Gene Symbol: EFTUD1
  Gene Name: elongation factor Tu GTP binding domain containing 1
  ENSP ID: ENSP00000452825
  MOD_RES (1)..(1): Any amino acid
XREDEQIRGITMKSSAISLHYATGNEEYLINLIDSPGHVDFSSEVSTAVRICDGCIIVVDAVEGVCPQINALTGTLFTSKVLEERAERETESQVNPNSEQGEQVYDWSTGLEDTDDSHLYFSPEQGNVVFTSAIDGWGF

SEQ ID NO: 27056 - protein, 16 aa, Homo sapiens
  Payload ID: 5328
  Gene Symbol: EFTUD1
  Gene Name: elongation factor Tu GTP binding domain containing 1
  ENSP ID: ENSP00000452990
MVLNSLDKMIQLQKNT

SEQ ID NO: 27057 - protein, 30 aa, Homo sapiens
  Payload ID: 5328
  Gene Symbol: EFTUD1
  Gene Name: elongation factor Tu GTP binding domain containing 1
  ENSP ID: ENSP00000454186
MVLNSLDKMIQLQKNTANIRNICVLAHVDH

SEQ ID NO: 27058 - protein, 937 aa, Homo sapiens
  Payload ID: 5329
  Gene Symbol: EFTUD2
  Gene Name: elongation factor Tu GTP binding domain containing 2
  Uniprot ID: Q15029
  ENSP ID: ENSP00000385873
MDDDDDDDDVGDHDDDHPGMEVVLHEDKKYYPTAEEVYGPEVETIVQEEDTQPLTEPIIKPVKTKKFTLMEQTLPVTVYEMDFLADLMDNSELIRNVTLCGHLHHGKTCFVDCLIEQTHPEIRKRYDQDLCYTDILFTEQERGVGIKSTPVTVVLPDTKGKSYLFNIMDTPGHVNFSDEVTAGLRISDGVVLFIDAAEGVMLNTERLIKHAVQERLAVTVCINKIDRLILELKLPPTDAYYKLRHIVDEVNGLISMYSTDENLILSPLLGNVCFSSSQYSICFTLGSFAKIYADTFGDINYQEFAKRLWGDIYFNPKTRKFTKKAPTSSSQRSFVEFILEPLYKILAQVVGDVDTSLPRTLDELGIHLTKEELKLNIRPLLRLVCKKFFGEFTGFVDMCVQHIPSPKVGAKPKIEHTYTGGVDSDLGEAMSDCDPDGPLMCHTTKMYSTDDGVQFHAFGRVLSGTIHAGQPVKVLGENYTLEDEEDSQICTVGRLWISVARYHIEVNRVPAGNWVLIEGVDQPIVKTATITEPRGNEEAQIFRPLKFNTTSVIKIAVEPVNPSELPKMLDGLRKVNKSYPSLTTKVEESGEHVILGTGELYLDCVMHDLRKMYSEIDIKVADPVVTFCETVVETSSLKCFAETPNKKNKITMIAEPLEKGLAEDIENEVVQITWNRKKLGEFFQTKYDWDLLAARSIWAFGPDATGPNILVDDTLPSEVDKALLGSVKDSIVQGFQWGTREGPLCDELIRNVKFKILDAVVAQEPLHRGGGQIIPTARRVVYSAFLMATPRLMEPYYFVEVQAPADCVSAVYTVLARRRGHVTQDAPIPGSPLYTIKAFIPAIDSFGFETDLRTHTQGQAFSLSVFHHWQIVPGDPLDKSIVIRPLEPQPAPHLAREFMIKTRRRKGLSEDVSISKFFDDPMLLELAKQDVVLNYPM

SEQ ID NO: 27059 - protein, 972 aa, Homo sapiens
  Payload ID: 5329
  Gene Symbol: EFTUD2
  Gene Name: elongation factor Tu GTP binding domain containing 2
  Uniprot ID: Q15029
  ENSP ID: ENSP00000392094
MDTDLYDEFGNYIGPELDSDEDDDELGRETKDLDEMDDDDDDDDVGDHDDDHPGMEVVLHEDKKYYPTAEEVYGPEVETIVQEEDTQPLTEPIIKPVKTKKFTLMEQTLPVTVYEMDFLADLMDNSELIRNVTLCGHLHHGKTCFVDCLIEQTHPEIRKRYDQDLCYTDILFTEQERGVGIKSTPVTVVLPDTKGKSYLFNIMDTPGHVNFSDEVTAGLRISDGVVLFIDAAEGVMLNTERLIKHAVQERLAVTVCINKIDRLILELKLPPTDAYYKLRHIVDEVNGLISMYSTDENLILSPLLGNVCFSSSQYSICFTLGSFAKIYADTFGDINYQEFAKRLWGDIYFNPKTRKFTKKAPTSSSQRSFVEFILEPLYKILAQVVGDVDTSLPRTLDELGIHLTKEELKLNIRPLLRLVCKKFFGEFTGFVDMCVQHIPSPKVGAKPKIEHTYTGGVDSDLGEAMSDCDPDGPLMCHTTKMYSTDDGVQFHAFGRVLSGTIHAGQPVKVLGENYTLEDEEDSQICTVGRLWISVARYHIEVNRVPAGNWVLIEGVDQPIVKTATITEPRGNEEAQIFRPLKFNTTSVIKIAVEPVNPSELPKMLDGLRKVNKSYPSLTTKVEESGEHVILGTGELYLDCVMHDLRKMYSEIDIKVADPVVTFCETVVETSSLKCFAETPNKKNKITMIAEPLEKGLAEDIENEVVQITWNRKKLGEFFQTKYDWDLLAARSIWAFGPDATGPNILVDDTLPSEVDKALLGSVKDSIVQGFQWGTREGPLCDELIRNVKFKILDAVVAQEPLHRGGGQIIPTARRVVYSAFLMATPRLMEPYYFVEVQAPADCVSAVYTVLARRRGHVTQDAPIPGSPLYTIKAFIPAIDSFGFETDLRTHTQGQAFSLSVFHHWQIVPGDPLDKSIVIRPLEPQPAPHLAREFMIKTRRRKGLSEDVSISKFFDDPMLLELAKQDVVLNYPM

SEQ ID NO: 27060 - protein, 148 aa, Homo sapiens
  Payload ID: 5329
  Gene Symbol: EFTUD2
  Gene Name: elongation factor Tu GTP binding domain containing 2
  ENSP ID: ENSP00000464882
MDTDLYDEFGNYIGPELDSDEDDDELGRETKDLDEMDDDDDDDDVGDHDDDHPGMEVVLHEDKKYYPTAEEVYGPEVETIVQEEDTQPLTEPIIKPVKTKKFTLMEQTLPVTVYEMDFLADLMDNSELIRNVTLCGHLHHGKTCFVDC

SEQ ID NO: 27061 - protein, 106 aa, Homo sapiens
  Payload ID: 5329
  Gene Symbol: EFTUD2
  Gene Name: elongation factor Tu GTP binding domain containing 2
  ENSP ID: ENSP00000464908
MDTDLYDEFGNYIGPELDSDEDDDELGRETKDLDEMDDDDDDDDVGDHDDDHPGMEVVLHEDKKYYPTAEEVYGPEVETIVQEEDTQPLTEPIIKPVKTKKFTLME

SEQ ID NO: 27062 - protein, 134 aa, Homo sapiens
  Payload ID: 5329
  Gene Symbol: EFTUD2
  Gene Name: elongation factor Tu GTP binding domain containing 2
  ENSP ID: ENSP00000465051
  MOD_RES (1)..(1): Any amino acid
XQTKYDWDLLAARSIWAFGPDATGPNILVDDTLPSEVDKALLGSVKDSIVQGFQWGTREGPLCDELIRNVKFKILDAVVAQEPLHRGGGQIIPTARRVVYSAFLMGARDSGCTHPRLPSVHHQSFYPGHRLFWL

SEQ ID NO: 27063 - protein, 962 aa, Homo sapiens
  Payload ID: 5329
  Gene Symbol: EFTUD2
  Gene Name: elongation factor Tu GTP binding domain containing 2
  Uniprot ID: Q15029
  ENSP ID: ENSP00000465058
MDTDLYDEFGNYIGPELDSDEDDDELGRETKDLDEMDDDDDDDDVGDHDDDHPGMEVVLHEDKKYYPTAEEVYGPEVETIVQEEDTQPLTEPIIKPVKTKKFTLMEQTLPVTVYEMDFLADLMDNSELIRNVTLCGHLHHGKTHPEIRKRYDQDLCYTDILFTEQERGVGIKSTPVTVVLPDTKGKSYLFNIMDTPGHVNFSDEVTAGLRISDGVVLFIDAAEGVMLNTERLIKHAVQERLAVTVCINKIDRLILELKLPPTDAYYKLRHIVDEVNGLISMYSTDENLILSPLLGNVCFSSSQYSICFTLGSFAKIYADTFGDINYQEFAKRLWGDIYFNPKTRKFTKKAPTSSSQRSFVEFILEPLYKILAQVVGDVDTSLPRTLDELGIHLTKEELKLNIRPLLRLVCKKFFGEFTGFVDMCVQHIPSPKVGAKPKIEHTYTGGVDSDLGEAMSDCDPDGPLMCHTTKMYSTDDGVQFHAFGRVLSGTIHAGQPVKVLGENYTLEDEEDSQICTVGRLWISVARYHIEVNRVPAGNWVLIEGVDQPIVKTATITEPRGNEEAQIFRPLKFNTTSVIKIAVEPVNPSELPKMLDGLRKVNKSYPSLTTKVEESGEHVILGTGELYLDCVMHDLRKMYSEIDIKVADPVVTFCETVVETSSLKCFAETPNKKNKITMIAEPLEKGLAEDIENEVVQITWNRKKLGEFFQTKYDWDLLAARSIWAFGPDATGPNILVDDTLPSEVDKALLGSVKDSIVQGFQWGTREGPLCDELIRNVKFKILDAVVAQEPLHRGGGQIIPTARRVVYSAFLMATPRLMEPYYFVEVQAPADCVSAVYTVLARRRGHVTQDAPIPGSPLYTIKAFIPAIDSFGFETDLRTHTQGQAFSLSVFHHWQIVPGDPLDKSIVIRPLEPQPAPHLAREFMIKTRRRKGLSEDVSISKFFDDPMLLELAKQDVVLNYPM

SEQ ID NO: 27064 - protein, 223 aa, Homo sapiens
  Payload ID: 5329
  Gene Symbol: EFTUD2
  Gene Name: elongation factor Tu GTP binding domain containing 2
  ENSP ID: ENSP00000467249
VETSSLKCFAETPNKKNKITMIAEPLEKGLAEDIENEVVQITWNRKKLGEFFQTKYDWDLLAARSIWAFGPDATGPNILVDDTLPSEVDKALLGSVKDSIVQGFQWGTREGPLCDELIRNVKFKILDAVVAQEPLHRGGGQIIPTARRVVYSAFLMIVPGDPLDKSIVIRPLEPQPAPHLAREFMIKTRRRKGLSEDVSISKFFDDPMLLELAKQDVVLNYPM

SEQ ID NO: 27065 - protein, 33 aa, Homo sapiens
  Payload ID: 5329
  Gene Symbol: EFTUD2
  Gene Name: elongation factor Tu GTP binding domain containing 2
  ENSP ID: ENSP00000467639
FGNYIGPELDSDEDDDELGRETKDLDENPLLSQ

SEQ ID NO: 27066 - protein, 972 aa, Homo sapiens; identical to SEQ ID NO: 27059
  Payload ID: 5329
  Gene Symbol: EFTUD2
  Gene Name: elongation factor Tu GTP binding domain containing 2
  Uniprot ID: Q15029
  ENSP ID: ENSP00000467805

SEQ ID NO: 27067 - protein, 38 aa, Homo sapiens
  Payload ID: 5329
  Gene Symbol: EFTUD2
  Gene Name: elongation factor Tu GTP binding domain containing 2
  ENSP ID: ENSP00000468284
VTSASPAPSTASASRWAPLPRSMPTPLKELPGPWKGKC

SEQ ID NO: 27068 - protein, 640 aa, Homo sapiens
  Payload ID: 5330
  Gene Symbol: ELL2
  Gene Name: elongation factor, RNA polymerase II, 2
  Uniprot ID: O00472
  ENSP ID: ENSP00000237853
MAAGGTGGLREEQRYGLSCGRLGQDNITVLHVKLTETAIRALETYQSHKNLIPFRPSIQFQGLHGLVKIPKNDPLNEVHNFNFYLSNVGKDNPQGSFDCIQQTFSSSGASQLNCLGFIQDKITVCATNDSYQMTRERMTQAEEESRNRSTKVIKPGGPYVGKRVQIRKAPQAVSDTVPERKRSTPMNPANTIRKTHSSSTISQRPYRDRVIHLLALKAYKKPELLARLQKDGVNQKDKNSLGAILQQVANLNSKDLSYTLKDYVFKELQRDWPGYSEIDRRSLESVLSRKLNPSQNAAGTSRSESPVCSSRDAVSSPQKRLLDSEFIDPLMNKKARISHLTNRVPPTLNGHLNPTSEKSAAGLPLPPAAAAIPTPPPLPSTYLPISHPPQIVNSNSNSPSTPEGRGTQDLPVDSFSQNDSIYEDQQDKYTSRTSLETLPPGSVLLKCPKPMEENHSMSHKKSKKKSKKHKEKDQIKKHDIETIEEKEEDLKREEEIAKLNNSSPNSSGGVKEDCTASMEPSAIELPDYLIKYIAIVSYEQRQNYKDDFNAEYDEYRALHARMETVARRFIKLDAQRKRLSPGSKEYQNVHEEVLQEYQKIKQSSPNYHEEKYRCEYLHNKLAHIKRLIGEFDQQQAESWS

SEQ ID NO: 27069 - protein, 137 aa, Homo sapiens
  Payload ID: 5330
  Gene Symbol: ELL2
  Gene Name: elongation factor, RNA polymerase II, 2
  ENSP ID: ENSP00000420894
  MOD_RES (1)..(1): Any amino acid
XEEKEEDLKREEEIAKLNNSSPNSSGGVKEDCTASMEPSAIELPDYLIKYIAIVSYEQRQNYKDDFNAEYDEYRALHARMETVARRFIKLDAQRKRLSPGSKEYQVNGFVTRWADFHILPSFFPCPAQPQPSQWPLE

SEQ ID NO: 27070 - protein, 151 aa, Homo sapiens
  Payload ID: 5330
  Gene Symbol: ELL2
  Gene Name: elongation factor, RNA polymerase II, 2
  ENSP ID: ENSP00000423915
MAAGGTGGLREEQRYGLSCGRLGQDNITVLHVKLTETAIRALETYQSHKNLIPFRPSIQFQGLHGVANLNSKDLSYTLKDYVFKELQRDWPGYSEIDRRSLESVLSRKLNPSQNAAGTSRSESPVCSSRDAVSSPQKRLLDSEFIDPLMNK

SEQ ID NO: 27071 - protein, 65 aa, Homo sapiens
  Payload ID: 5330
  Gene Symbol: ELL2
  Gene Name: elongation factor, RNA polymerase II, 2
  ENSP ID: ENSP00000489270
  MOD_RES (1)..(1): Any amino acid
XLSCGRLGQDNITVLHVKLTETAIRALETYQSHKNLIPFRPSIQFQGLHGMPVFFKRTLQTSHKA

SEQ ID NO: 27072 - protein, 800 aa, Homo sapiens
  Payload ID: 5331
  Gene Symbol: ELP2
  Gene Name: elongator acetyltransferase complex subunit 2
  Uniprot ID: Q6IA86
  ENSP ID: ENSP00000257191
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 27073 - protein, 821 aa, Homo sapiens
  Payload ID: 5331
  Gene Symbol: ELP2
  Gene Name: elongator acetyltransferase complex subunit 2
  Uniprot ID: Q6IA86
  ENSP ID: ENSP00000316051
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVTWKTGQVERGRAWKPPASLALCSRSCDSMVSCYASILCKALWKEKLHTFWHHNRISFLPSAFRPIPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 27074 - protein, 826 aa, Homo sapiens
  Payload ID: 5331
  Gene Symbol: ELP2
  Gene Name: elongator acetyltransferase complex subunit 2
  Uniprot ID: Q6IA86
  ENSP ID: ENSP00000350967
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 27075 - protein, 756 aa, Homo sapiens
  Payload ID: 5331
  Gene Symbol: ELP2
  Gene Name: elongator acetyltransferase complex subunit 2
  Uniprot ID: Q6IA86
  ENSP ID: ENSP00000391202
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 27076 - protein, 891 aa, Homo sapiens
  Payload ID: 5331
  Gene Symbol: ELP2
  Gene Name: elongator acetyltransferase complex subunit 2
  Uniprot ID: Q6IA86
  ENSP ID: ENSP00000414851
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVTWKTGQVERGRAWKPPASLALCSRSCDSMVSCYASILCKALWKEKLHTFWHHNRISFLPSAFRPIPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 27077 - protein, 51 aa, Homo sapiens
  Payload ID: 5331
  Gene Symbol: ELP2
  Gene Name: elongator acetyltransferase complex subunit 2
  ENSP ID: ENSP00000438533
MVAPVLETSHVFCCPNRVRGVLNWSSGPRGLLAFGTSCSVVLYDPLPLLLN

SEQ ID NO: 27078 - protein, 57 aa, Homo sapiens
  Payload ID: 5331
  Gene Symbol: ELP2
  Gene Name: elongator acetyltransferase complex subunit 2
  ENSP ID: ENSP00000440426
MCLQTLNFGNGFALALCLSFLPNTDVPILACGNDDCRIHIFAQQNDQFQKVLSLCGH

SEQ ID NO: 27079 - protein, 51 aa, Homo sapiens; identical to SEQ ID NO: 27077
  Payload ID: 5331
  Gene Symbol: ELP2
  Gene Name: elongator acetyltransferase complex subunit 2
  ENSP ID: ENSP00000440516

SEQ ID NO: 27080 - protein, 47 aa, Homo sapiens
  Payload ID: 5331
  Gene Symbol: ELP2
  Gene Name: elongator acetyltransferase complex subunit 2
  ENSP ID: ENSP00000440651
DEEELLTSTGFEYQQVAFQPSILTEPPTEDHLLQNTLWPEVQKLASF

SEQ ID NO: 27081 - protein, 120 aa, Homo sapiens
  Payload ID: 5331
  Gene Symbol: ELP2
  Gene Name: elongator acetyltransferase complex subunit 2
  ENSP ID: ENSP00000440774
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQAMKDLFMRCMLFTRGGHQILHYVH

SEQ ID NO: 27082 - protein, 705 aa, Homo sapiens
  Payload ID: 5331
  Gene Symbol: ELP2
  Gene Name: elongator acetyltransferase complex subunit 2
  Uniprot ID: Q6IA86
  ENSP ID: ENSP00000443555
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFVELFGLVIGVLTASISSLGVETKRWLSGVSATPLMTVLSTTLAPAPQSWTWVGL

SEQ ID NO: 27083 - protein, 756 aa, Homo sapiens
  Payload ID: 5331
  Gene Symbol: ELP2
  Gene Name: elongator acetyltransferase complex subunit 2
  Uniprot ID: Q6IA86
  ENSP ID: ENSP00000443800
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 27084 - protein, 101 aa, Homo sapiens
  Payload ID: 5331
  Gene Symbol: ELP2
  Gene Name: elongator acetyltransferase complex subunit 2
  ENSP ID: ENSP00000468091
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQIWARL

SEQ ID NO: 27085 - protein, 547 aa, Homo sapiens
  Payload ID: 5332
  Gene Symbol: ELP3
  Gene Name: elongator acetyltransferase complex subunit 3
  Uniprot ID: Q9H9T3
  ENSP ID: ENSP00000256398
MRQKRKGDLSPAELMMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 27086 - protein, 455 aa, Homo sapiens
  Payload ID: 5332
  Gene Symbol: ELP3
  Gene Name: elongator acetyltransferase complex subunit 3
  Uniprot ID: Q9H9T3
  ENSP ID: ENSP00000369711
MCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 27087 - protein, 140 aa, Homo sapiens
  Payload ID: 5332
  Gene Symbol: ELP3
  Gene Name: elongator acetyltransferase complex subunit 3
  ENSP ID: ENSP00000427833
RTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVDVLGQRQRGGHHRSCSL

SEQ ID NO: 27088 - protein, 41 aa, Homo sapiens
  Payload ID: 5332
  Gene Symbol: ELP3
  Gene Name: elongator acetyltransferase complex subunit 3
  ENSP ID: ENSP00000428357
MPKLKAKPIRTASGIAVVAVMCKPHRCPHISFTGNICVQPP

SEQ ID NO: 27089 - protein, 533 aa, Homo sapiens
  Payload ID: 5332
  Gene Symbol: ELP3
  Gene Name: elongator acetyltransferase complex subunit 3
  Uniprot ID: Q9H9T3
  ENSP ID: ENSP00000428449
MMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 27090 - protein, 191 aa, Homo sapiens
  Payload ID: 5332
  Gene Symbol: ELP3
  Gene Name: elongator acetyltransferase complex subunit 3
  ENSP ID: ENSP00000428532
MMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAV

SEQ ID NO: 27091 - protein, 475 aa, Homo sapiens
  Payload ID: 5332
  Gene Symbol: ELP3
  Gene Name: elongator acetyltransferase complex subunit 3
  ENSP ID: ENSP00000429180
MPKLKAKPIRTASGIAVVAVMCKPHRCPHISFTGNICVYCPGGPDSDFEYSTQSYTGYEPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 27092 - protein, 134 aa, Homo sapiens
  Payload ID: 5332
  Gene Symbol: ELP3
  Gene Name: elongator acetyltransferase complex subunit 3
  ENSP ID: ENSP00000429248
MMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSYTGYEPTSMRAIRARYDPFLQT

SEQ ID NO: 27093 - protein, 113 aa, Homo sapiens
  Payload ID: 5332
  Gene Symbol: ELP3
  Gene Name: elongator acetyltransferase complex subunit 3
  ENSP ID: ENSP00000429446
MMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDFEYSTQSY

SEQ ID NO: 27094 - protein, 45 aa, Homo sapiens
  Payload ID: 5332
  Gene Symbol: ELP3
  Gene Name: elongator acetyltransferase complex subunit 3
  ENSP ID: ENSP00000429465
MRQKRKGDLSPAELMMLTIGDVIKQLIEAHEQGKDIDLNKLLSWL

SEQ ID NO: 27095 - protein, 106 aa, Homo sapiens
  Payload ID: 5332
  Gene Symbol: ELP3
  Gene Name: elongator acetyltransferase complex subunit 3
  ENSP ID: ENSP00000429573
MMLTIGDVIKQLIEAHEQGKDIDLNKVKTKTAAKYGLSAQPRLVDIIAAVPPQYRKVLMPKLKAKPIRTASGIAVVAVMCKPHRCPHISFTGNICVYCPGGPDSDF

SEQ ID NO: 27096 - protein, 45 aa, Homo sapiens; identical to SEQ ID NO: 27094
  Payload ID: 5332
  Gene Symbol: ELP3
  Gene Name: elongator acetyltransferase complex subunit 3
  ENSP ID: ENSP00000430253

SEQ ID NO: 27097 - protein, 66 aa, Homo sapiens
  Payload ID: 5332
  Gene Symbol: ELP3
  Gene Name: elongator acetyltransferase complex subunit 3
  ENSP ID: ENSP00000430942
IQEIHHKVRPYQVELVRRDYVANGGWETFLSYEDPDQDILIGLLRLRKCSEETFRFELGGGSRKNS

SEQ ID NO: 27098 - protein, 428 aa, Homo sapiens
  Payload ID: 5332
  Gene Symbol: ELP3
  Gene Name: elongator acetyltransferase complex subunit 3
  Uniprot ID: Q9H9T3
  ENSP ID: ENSP00000445558
MSTHQFYRKYMCPTSMRAIRARYDPFLQTRHRIEQLKQLGHSVDKVEFIVMGGTFMALPEEYRDYFIRNLHDALSGHTSNNIYEAVKYSERSLTKCIGITIETRPDYCMKRHLSDMLTYGCTRLEIGVQSVYEDVARDTNRGHTVKAVCESFHLAKDSGFKVVAHMMPDLPNVGLERDIEQFTEFFENPAFRPDGLKLYPTLVIRGTGLYELWKSGRYKSYSPSDLVELVARILALVPPWTRVYRVQRDIPMPLVSSGVEHGNLRELALARMKDLGIQCRDVRTREVGIQEIHHKVRPYQVELVRRDYVANGGWETFLSYEDPDQDILIGLLRLRKCSEETFRFELGGGVSIVRELHVYGSVVPVSSRDPTKFQHQGFGMLLMEEAERIAREEHGSGKIAVISGVGTRNYYRKIGYRLQGPYMVKMLK

SEQ ID NO: 27099 - protein, 424 aa, Homo sapiens
  Payload ID: 5333
  Gene Symbol: ELP4
  Gene Name: elongator acetyltransferase complex subunit 4
  Uniprot ID: Q96EB1
  ENSP ID: ENSP00000298937
MAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIERLHLPPDLSDTVSRSSKMDLAESAKRLGPGCGMMAGGKKHLDF

SEQ ID NO: 27100 - protein, 476 aa, Homo sapiens
  Payload ID: 5333
  Gene Symbol: ELP4
  Gene Name: elongator acetyltransferase complex subunit 4
  Uniprot ID: Q96EB1
  ENSP ID: ENSP00000368461
MAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEQIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIEWVQDNYLRQERNIYPPGFSYLLKQKDSAWGEGSLQHSTFLMSFLAKATAFASRLVRHSEPLKQNGSGRIRQAAGPRLWHDGRRQEAPGLLGIPP

SEQ ID NO: 27101 - protein, 535 aa, Homo sapiens
  Payload ID: 5333
  Gene Symbol: ELP4
  Gene Name: elongator acetyltransferase complex subunit 4
  ENSP ID: ENSP00000379267
MAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEIGPVSSSRFGHYYDASKRMPQELIEASNWHGFFLPEKISSTLKVEPCSLTPGYTKLLQFIQNIIYEEGFDGSNPQKKQRNILRIGIQNLGSPLWGDDICCAENGGNSHSLTKFLYVLRGLLRTSLSACIITMPTHLIQNKAIIARVTTLSDVVVGLESFIGSERETNPLYKDYHGLIHIRQIPRLNNLICDESDVKDLAFKLKRKLFTIEAGVQWHDLGSRQPRLLGSSNSPASASLVAGITGAHHHTQLIFVFLVEMGFHHVGQAGLELLTSGDSSASASQSAGITGMSYRARPRALYFKENKSKVGARQLLETREEHLSSRLLILTQAERLCMGRRFFTAFHIFNELPCKGDCICLQTCQTQ

SEQ ID NO: 27102 - protein, 185 aa, Homo sapiens
  Payload ID: 5333
  Gene Symbol: ELP4
  Gene Name: elongator acetyltransferase complex subunit 4
  ENSP ID: ENSP00000432642
MAAVATCGSVAASTGSAVATASKSNVTSFQRRGPRASVTNDSGPRLVSIAGTRPSVRNGQLLVSTGLPALDQLLGGGLAVGTVLLIEEDKYNIYSPLLFKYFLAEGIVNGHTLLVASAKEDPANILQELPAPLLDDKCKKEFDEDVYNHKTPESNIKMKIAWRYQLLPKMEANWTSIIFKIWSLL

SEQ ID NO: 27103 - protein, 316 aa, Homo sapiens
  Payload ID: 5334
  Gene Symbol: ELP5
  Gene Name: elongator acetyltransferase complex subunit 5
  Uniprot ID: Q8TE02
  ENSP ID: ENSP00000346412
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVDPTTHLTFNLHLSKKEREARDSLILPFQFSSEKQQALLRPRPGQATSHIFYEPDAYDDLDQEDPDDDLDI

SEQ ID NO: 27104 - protein, 279 aa, Homo sapiens
  Payload ID: 5334
  Gene Symbol: ELP5
  Gene Name: elongator acetyltransferase complex subunit 5
  Uniprot ID: Q8TE02
  ENSP ID: ENSP00000349111
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVSKNAKARTRKCSLVSGHGRENKSCRGWGWGQGF

SEQ ID NO: 27105 - protein, 316 aa, Homo sapiens; identical to SEQ ID NO: 27103
  Payload ID: 5334
  Gene Symbol: ELP5
  Gene Name: elongator acetyltransferase complex subunit 5
  Uniprot ID: Q8TE02
  ENSP ID: ENSP00000379868

SEQ ID NO: 27106 - protein, 316 aa, Homo sapiens; identical to SEQ ID NO: 27103
  Payload ID: 5334
  Gene Symbol: ELP5
  Gene Name: elongator acetyltransferase complex subunit 5
  Uniprot ID: Q8TE02
  ENSP ID: ENSP00000379869

SEQ ID NO: 27107 - protein, 95 aa, Homo sapiens
  Payload ID: 5334
  Gene Symbol: ELP5
  Gene Name: elongator acetyltransferase complex subunit 5
  ENSP ID: ENSP00000458691
MTPSEGARAGTGRELEMLDSLLALGGLVLLRDSVEWEGRSLLKALVKKSALCGEQVHILGCEVSEEEFREGFDSDINNRLVYHDFFRDPLNWSKT

SEQ ID NO: 27108 - protein, 262 aa, Homo sapiens
  Payload ID: 5334
  Gene Symbol: ELP5
  Gene Name: elongator acetyltransferase complex subunit 5
  ENSP ID: ENSP00000459010
  MOD_RES (1)..(1): Any amino acid
XDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVDPTTHLTFNLHLSKKEREARDSLILPFQFSSEK

SEQ ID NO: 27109 - protein, 108 aa, Homo sapiens
  Payload ID: 5334
  Gene Symbol: ELP5
  Gene Name: elongator acetyltransferase complex subunit 5
  ENSP ID: ENSP00000459248
  MOD_RES (1)..(1): Any amino acid
XLVYHDFFRDPLNWSKTEEAFPGGPLGALRAMCKRTDPVPVTIALDSLSWLLLRLPCTTLCQVLHAVSHQDSCPDSVVLHPSGLQPGSPRGALCRVPALLRSSYTPGI

SEQ ID NO: 27110 - protein, 117 aa, Homo sapiens
  Payload ID: 5334
  Gene Symbol: ELP5
  Gene Name: elongator acetyltransferase complex subunit 5
  ENSP ID: ENSP00000459535
DSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVTAPQWGK

SEQ ID NO: 27111 - protein, 179 aa, Homo sapiens
  Payload ID: 5334
  Gene Symbol: ELP5
  Gene Name: elongator acetyltransferase complex subunit 5
  Uniprot ID: Q8TE02
  ENSP ID: ENSP00000459633
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGETPPSLFPLIHLPLPRSVPLFLSTLE

SEQ ID NO: 27112 - protein, 279 aa, Homo sapiens; identical to SEQ ID NO: 27104
  Payload ID: 5334
  Gene Symbol: ELP5
  Gene Name: elongator acetyltransferase complex subunit 5
  Uniprot ID: Q8TE02
  ENSP ID: ENSP00000459835

SEQ ID NO: 27113 - protein, 209 aa, Homo sapiens
  Payload ID: 5334
  Gene Symbol: ELP5
  Gene Name: elongator acetyltransferase complex subunit 5
  ENSP ID: ENSP00000459897
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQR

SEQ ID NO: 27114 - protein, 230 aa, Homo sapiens
  Payload ID: 5334
  Gene Symbol: ELP5
  Gene Name: elongator acetyltransferase complex subunit 5
  ENSP ID: ENSP00000460596
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEG

SEQ ID NO: 27115 - protein, 245 aa, Homo sapiens
  Payload ID: 5334
  Gene Symbol: ELP5
  Gene Name: elongator acetyltransferase complex subunit 5
  ENSP ID: ENSP00000460947
  MOD_RES (1)..(1): Any amino acid
XAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPTAGSPAA

SEQ ID NO: 27116 - protein, 179 aa, Homo sapiens; identical to SEQ ID NO: 27111
  Payload ID: 5334
  Gene Symbol: ELP5
  Gene Name: elongator acetyltransferase complex subunit 5
  Uniprot ID: Q8TE02
  ENSP ID: ENSP00000461489

SEQ ID NO: 27117 - protein, 43 aa, Homo sapiens
  Payload ID: 5334
  Gene Symbol: ELP5
  Gene Name: elongator acetyltransferase complex subunit 5
  ENSP ID: ENSP00000461890
MCKRTDPVPVTIALDSLSWLLLRLPCTTLCQVLHAVSHQDSCP

SEQ ID NO: 27118 - protein, 266 aa, Homo sapiens
  Payload ID: 5335
  Gene Symbol: ELP6
  Gene Name: elongator acetyltransferase complex subunit 6
  Uniprot ID: Q0PNE2
  ENSP ID: ENSP00000296149
MFVELNNLLNTTPDRAEQGKLTLLCDAKTDGSFLVHHFLSFYLKANCKVCFVALIQSFSHYSIVGQKLGVSLTMARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQLRILWRRPSQPAVHRDQSFTYQYKIQDKSVSFFAKGMSPAVL

SEQ ID NO: 27119 - protein, 60 aa, Homo sapiens
  Payload ID: 5335
  Gene Symbol: ELP6
  Gene Name: elongator acetyltransferase complex subunit 6
  ENSP ID: ENSP00000390437
MFVELNNLLNTTPDRAEQGKLTLLCDAKTDGSFLVHHFLSFYLKGCQPDHGAGAWAACVP

SEQ ID NO: 27120 - protein, 68 aa, Homo sapiens
  Payload ID: 5335
  Gene Symbol: ELP6
  Gene Name: elongator acetyltransferase complex subunit 6
  ENSP ID: ENSP00000394673
MARERGQLVFLEGLKSAVDVVFQAQKEPHPLQFLRHLRKNFSPGLVFNITGLRLVFLLFLLSEHWPQT

SEQ ID NO: 27121 - protein, 113 aa, Homo sapiens
  Payload ID: 5335
  Gene Symbol: ELP6
  Gene Name: elongator acetyltransferase complex subunit 6
  ENSP ID: ENSP00000400643
MARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKVLMELPSLRPP

SEQ ID NO: 27122 - protein, 193 aa, Homo sapiens
  Payload ID: 5335
  Gene Symbol: ELP6
  Gene Name: elongator acetyltransferase complex subunit 6
  ENSP ID: ENSP00000402399
MARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQLRILWRRPSQPAVHRDQSFTYQYKIQDKSVSFFAKGMSPAVL

SEQ ID NO: 27123 - protein, 80 aa, Homo sapiens
  Payload ID: 5335
  Gene Symbol: ELP6
  Gene Name: elongator acetyltransferase complex subunit 6
  ENSP ID: ENSP00000402445
MARERGQLVFLEGLKSAVDVVFQAQKEPHPLQFLREANAGNLKPLFEFVREALKPVDSGEARWTYPVLLVDDLSVLLSLG

SEQ ID NO: 27124 - protein, 151 aa, Homo sapiens
  Payload ID: 5335
  Gene Symbol: ELP6
  Gene Name: elongator acetyltransferase complex subunit 6
  ENSP ID: ENSP00000406130
MARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQ

SEQ ID NO: 27125 - protein, 99 aa, Homo sapiens
  Payload ID: 5335
  Gene Symbol: ELP6
  Gene Name: elongator acetyltransferase complex subunit 6
  ENSP ID: ENSP00000410790
MARERGQLVFLEGLKSAVDVVFQAQKEPHPLQFLREANAGNLKPLFEFVREALKPVDSGEARWTYPVLLVDDLSVLLSLGMGAVAVLDFIHYCRATVCW

SEQ ID NO: 27126 - protein, 193 aa, Homo sapiens; identical to SEQ ID NO: 27122
  Payload ID: 5335
  Gene Symbol: ELP6
  Gene Name: elongator acetyltransferase complex subunit 6
  ENSP ID: ENSP00000412593

SEQ ID NO: 27127 - protein, 157 aa, Homo sapiens
  Payload ID: 5335
  Gene Symbol: ELP6
  Gene Name: elongator acetyltransferase complex subunit 6
  ENSP ID: ENSP00000415301
MARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQVCRGLL

SEQ ID NO: 27128 - protein, 279 aa, Homo sapiens
  Payload ID: 5336
  Gene Symbol: ELOVL1
  Gene Name: ELOVL fatty acid elongase 1
  Uniprot ID: Q9BW60
  ENSP ID: ENSP00000361536
MEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 27129 - protein, 252 aa, Homo sapiens
  Payload ID: 5336
  Gene Symbol: ELOVL1
  Gene Name: ELOVL fatty acid elongase 1
  Uniprot ID: Q9BW60
  ENSP ID: ENSP00000416024
MEAVVNLYQEVMKHADPRIQGYPLMGSPLLMTSILLTYVYFVLSLGPRIMANRKPFQLRGFMIVYNFSLVALSLYIVYEMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 27130 - protein, 279 aa, Homo sapiens; identical to SEQ ID NO: 27128
  Payload ID: 5336
  Gene Symbol: ELOVL1
  Gene Name: ELOVL fatty acid elongase 1
  Uniprot ID: Q9BW60
  ENSP ID: ENSP00000477602

SEQ ID NO: 27131 - protein, 296 aa, Homo sapiens
  Payload ID: 5337
  Gene Symbol: ELOVL2
  Gene Name: ELOVL fatty acid elongase 2
  Uniprot ID: Q9NXB9
  ENSP ID: ENSP00000346693
MEHLKAFDDEINAFLDNMFGPRDSRVRGWFMLDSYLPTFFLTVMYLLSIWLGNKYMKNRPALSLRGILTLYNLGITLLSAYMLAELILSTWEGGYNLQCQDLTSAGEADIRVAKVLWWYYFSKSVEFLDTIFFVLRKKTSQITFLHVYHHASMFNIWWCVLNWIPCGQSFFGPTLNSFIHILMYSYYGLSVFPSMHKYLWWKKYLTQAQLVQFVLTITHTMSAVVKPCGFPFGCLIFQSSYMLTLVILFLNFYVQTYRKKPMKKDMQEPPAGKEVKNGFSKAYFTAANGVMNKKAQ

SEQ ID NO: 27132 - protein, 270 aa, Homo sapiens
  Payload ID: 5338
  Gene Symbol: ELOVL3
  Gene Name: ELOVL fatty acid elongase 3
  Uniprot ID: Q9HB03
  ENSP ID: ENSP00000359022
MVTAMNVSHEVNQLFQPYNFELSKDMRPFFEEYWATSFPIALIYLVLIAVGQNYMKERKGFNLQGPLILWSFCLAIFSILGAVRMWGIMGTVLLTGGLKQTVCFINFIDNSTVKFWSWVFLLSKVIELGDTAFIILRKRPLIFIHWYHHSTVLVYTSFGYKNKVPAGGWFVTMNFGVHAIMYTYYTLKAANVKPPKMLPMLITSLQILQMFVGAIVSILTYIWRQDQGCHTTMEHLFWSFILYMTYFILFAHFFCQTYIRPKVKAKTKSQ

SEQ ID NO: 27133 - protein, 314 aa, Homo sapiens
  Payload ID: 5339
  Gene Symbol: ELOVL4
  Gene Name: ELOVL fatty acid elongase 4
  Uniprot ID: Q9GZR5
  ENSP ID: ENSP00000358831
MGLLDSEPGSVLNVVSTALNDTVEFYRWTWSIADKRVENWPLMQSPWPTLSISTLYLLFVWLGPKWMKDREPFQMRLVLIIYNFGMVLLNLFIFRELFMGSYNAGYSYICQSVDYSNNVHEVRIAAALWWYFVSKGVEYLDTVFFILRKKNNQVSFLHVYHHCTMFTLWWIGIKWVAGGQAFFGAQLNSFIHVIMYSYYGLTAFGPWIQKYLWWKRYLTMLQLIQFHVTIGHTALSLYTDCPFPKWMHWALIAYAISFIFLFLNFYIRTYKEPKKPKAGKTAMNGISANGVSKSEKQLMIENGKKQKNGKAKGD

SEQ ID NO: 27134 - protein, 299 aa, Homo sapiens
  Payload ID: 5340
  Gene Symbol: ELOVL5
  Gene Name: ELOVL fatty acid elongase 5
  Uniprot ID: Q9NYP7
  ENSP ID: ENSP00000306640
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 27135 - protein, 88 aa, Homo sapiens
  Payload ID: 5340
  Gene Symbol: ELOVL5
  Gene Name: ELOVL fatty acid elongase 5
  Uniprot ID: Q9NYP7
  ENSP ID: ENSP00000359951
MEHFDASLSTYFKALLGPRGISSSVLRMGPPLHTVVGWLQQLQAAHSEEEEKMFHLCGFKHKEVVSQSSLPAVIPQNSLATIASHAPA

SEQ ID NO: 27136 - protein, 326 aa, Homo sapiens
  Payload ID: 5340
  Gene Symbol: ELOVL5
  Gene Name: ELOVL fatty acid elongase 5
  Uniprot ID: Q9NYP7
  ENSP ID: ENSP00000359956
MEHFDASLSTYFKALLGPRDTRVKGWFLLDNYIPTFICSVIYLLIVWLGPKYMRNKQPFSCRGILVVYNLGLTLLSLYMFCESKREQPRRSACASRTDPSTQQQLPENRLVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 27137 - protein, 262 aa, Homo sapiens
  Payload ID: 5340
  Gene Symbol: ELOVL5
  Gene Name: ELOVL fatty acid elongase 5
  ENSP ID: ENSP00000440728
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSSVCADNHPDQLRGHLAVHIPSWLVVFPDWIHDFPDCSLHKLLHSDLQQERGLPKERPPEGPPEWVHGCCEWTHQQLFTPGKQCEAKEAAEGLKSKN

SEQ ID NO: 27138 - protein, 265 aa, Homo sapiens
  Payload ID: 5341
  Gene Symbol: ELOVL6
  Gene Name: ELOVL fatty acid elongase 6
  Uniprot ID: Q9H5J4
  ENSP ID: ENSP00000304736
MNMSVLTLQEYEFEKQFNENEAIQWMQENWKKSFLFSALYAAFIFGGRHLMNKRAKFELRKPLVLWSLTLAVFSIFGALRTGAYMVYILMTKGLKQSVCDQGFYNGPVSKFWAYAFVLSKAPELGDTIFIILRKQKLIFLHWYHHITVLLYSWYSYKDMVAGGGWFMTMNYGVHAVMYSYYALRAAGFRVSRKFAMFITLSQITQMLMGCVVNYLVFCWMQHDQCHSHFQNIFWSSLMYLSYLVLFCHFFFEAYIGKMRKTTKAE

SEQ ID NO: 27139 - protein, 265 aa, Homo sapiens; identical to SEQ ID NO: 27138
  Payload ID: 5341
  Gene Symbol: ELOVL6
  Gene Name: ELOVL fatty acid elongase 6
  Uniprot ID: Q9H5J4
  ENSP ID: ENSP00000378105

SEQ ID NO: 27140 - protein, 98 aa, Homo sapiens
  Payload ID: 5341
  Gene Symbol: ELOVL6
  Gene Name: ELOVL fatty acid elongase 6
  ENSP ID: ENSP00000424023
MNMSVLTLQEYEFEKQFNENEAIQWMQENWKKSFLFSALYAAFIFGGRHLMNKRAKFELRKPLVLWSLTLAVFRCYNNLKQLTLYSVLFELVLIWCTF

SEQ ID NO: 27141 - protein, 136 aa, Homo sapiens
  Payload ID: 5341
  Gene Symbol: ELOVL6
  Gene Name: ELOVL fatty acid elongase 6
  ENSP ID: ENSP00000425488
MNMSVLTLQEYEFEKQFNENEAIQWMQENWKKSFLFSALYAAFIFGGRHLMNKRAKFELRKPLVLWSLTLAVFSIFGALRTGAYMVYILMTKGLKQSVCDQGFYNGPVSKFWAYAFVLSKAPELGDTIFIILRKQK

SEQ ID NO: 27142 - protein, 108 aa, Homo sapiens
  Payload ID: 5341
  Gene Symbol: ELOVL6
  Gene Name: ELOVL fatty acid elongase 6
  ENSP ID: ENSP00000426086
MNMSVLTLQEYEFEKQFNENEAIQWMQENWKKSFLFSALYAAFIFGGRHLMNKRAKFELRKPLVLWSLTLAVFSIFGALRTGAYMVYILMTKGLKQSVCDQGFYNGPV

SEQ ID NO: 27143 - protein, 281 aa, Homo sapiens
  Payload ID: 5342
  Gene Symbol: ELOVL7
  Gene Name: ELOVL fatty acid elongase 7
  Uniprot ID: A1L3X0
  ENSP ID: ENSP00000402634
MAFSDLTSRTVHLYDNWIKDADPRVEDWLLMSSPLPQTILLGFYVYFVTSLGPKLMENRKPFELKKAMITYNFFIVLFSVYMCYEFVMSGWGIGYSFRCDIVDYSRSPTALRMARTCWLYYFSKFIELLDTIFFVLRKKNSQVTFLHVFHHTIMPWTWWFGVKFAAGGLGTFHALLNTAVHVVMYSYYGLSALGPAYQKYLWWKKYLTSLQLVQFVIVAIHISQFFFMEDCKYQFPVFACIIMSYSFMFLLLFLHFWYRAYTKGQRLPKTVKNGTCKNKDN

SEQ ID NO: 27144 - protein, 268 aa, Homo sapiens
  Payload ID: 5342
  Gene Symbol: ELOVL7
  Gene Name: ELOVL fatty acid elongase 7
  ENSP ID: ENSP00000421043
MEKPINILYPRVEDWLLMSSPLPQTILLGFYVYFVTSLGPKLMENRKPFELKKAMITYNFFIVLFSVYMCYEFVMSGWGIGYSFRCDIVDYSRSPTALRMARTCWLYYFSKFIELLDTIFFVLRKKNSQVTFLHVFHHTIMPWTWWFGVKFAAGGLGTFHALLNTAVHVVMYSYYGLSALGPAYQKYLWWKKYLTSLQLVQFVIVAIHISQFFFMEDCKYQFPVFACIIMSYSFMFLLLFLHFWYRAYTKGQRLPKTVKNGTCKNKDN

SEQ ID NO: 27145 - protein, 88 aa, Homo sapiens
  Payload ID: 5342
  Gene Symbol: ELOVL7
  Gene Name: ELOVL fatty acid elongase 7
  ENSP ID: ENSP00000422602
MAFSDLTSRTVHLYDNWIKDADPRVEDWLLMSSPLPQTILLGFYVYFVTSLGPKLMENRKPFELKKAMITYNFFIVLFSVYMCYEILF

SEQ ID NO: 27146 - protein, 165 aa, Homo sapiens
  Payload ID: 5342
  Gene Symbol: ELOVL7
  Gene Name: ELOVL fatty acid elongase 7
  ENSP ID: ENSP00000424081
MAFSDLTSRTVHLYDNWIKDADPRVEDWLLMSSPLPQTILLGFYVYFVTSLGPKLMENRKPFELKKAMITYNFFIVLFSVYMCYEFVMSGWGIGYSFRCDIVDYSRSPTALRMARTCWLYYFSKFIELLDTIFFVLRKKNSQVTFLHVFHHTIMPWTWWFGVKFA

SEQ ID NO: 27147 - protein, 281 aa, Homo sapiens; identical to SEQ ID NO: 27143
  Payload ID: 5342
  Gene Symbol: ELOVL7
  Gene Name: ELOVL fatty acid elongase 7
  Uniprot ID: A1L3X0
  ENSP ID: ENSP00000424123

SEQ ID NO: 27148 - protein, 71 aa, Homo sapiens
  Payload ID: 5342
  Gene Symbol: ELOVL7
  Gene Name: ELOVL fatty acid elongase 7
  ENSP ID: ENSP00000425127
MAFSDLTSRTVHLYDNWIKDADPRVEDWLLMSSPLPQTILLGFYVYFVTSLGPKLMENRKPFELKKAMITL

SEQ ID NO: 27149 - protein, 165 aa, Homo sapiens; identical to SEQ ID NO: 27146
  Payload ID: 5342
  Gene Symbol: ELOVL7
  Gene Name: ELOVL fatty acid elongase 7
  ENSP ID: ENSP00000426400

SEQ ID NO: 27150 - protein, 327 aa, Homo sapiens
  Payload ID: 5343
  Gene Symbol: EMB
  Gene Name: embigin
  Uniprot ID: Q6PCB8
  ENSP ID: ENSP00000302289
MRALPGLLEARARTPRLLLLQCLLAAARPSSADGSAPDSPFTSPPLREEIMANNFSLESHNISLTEHSSMPVEKNITLERPSNVNLTCQFTTSGDLNAVNVTWKKDGEQLENNYLVSATGSTLYTQYRFTIINSKQMGSYSCFFREEKEQRGTFNFKVPELHGKNKPLISYVGDSTVLTCKCQNCFPLNWTWYSSNGSVKVPVGVQMNKYVINGTYANETKLKITQLLEEDGESYWCRALFQLGESEEHIELVVLSYLVPLKPFLVIVAEVILLVATILLCEKYTQKKKKHSDEGKEFEQIEQLKSDDSNGIENNVPRHRKNESLGQ

SEQ ID NO: 27151 - protein, 273 aa, Homo sapiens
  Payload ID: 5343
  Gene Symbol: EMB
  Gene Name: embigin
  ENSP ID: ENSP00000425215
MRALPGLLEARARTPRLLLLQCLLAAARPSSADGSAPDSPFTSPPLREEIMANNFSLESHNISLTGSTLYTQYRFTIINSKQMGSYSCFFREEKEQRGTFNFKVPELHGKNKPLISYVGDSTVLTCKCQNCFPLNWTWYSSNGSVKVPVGVQMNKYVINGTYANETKLKITQLLEEDGESYWCRALFQLGESEEHIELVVLSYLVPLKPFLVIVAEVILLVATILLCEKYTQKKKKHSDEGKEFEQIEQLKSDDSNGIENNVPRHRKNESLGQ

SEQ ID NO: 27152 - protein, 277 aa, Homo sapiens
  Payload ID: 5343
  Gene Symbol: EMB
  Gene Name: embigin
  Uniprot ID: Q6PCB8
  ENSP ID: ENSP00000426404
MANNFSLESHNISLTEHSSMPVEKNITLERPSNVNLTCQFTTSGDLNAVNVTWKKDGEQLENNYLVSATGSTLYTQYRFTIINSKQMGSYSCFFREEKEQRGTFNFKVPELHGKNKPLISYVGDSTVLTCKCQNCFPLNWTWYSSNGSVKVPVGVQMNKYVINGTYANETKLKITQLLEEDGESYWCRALFQLGESEEHIELVVLSYLVPLKPFLVIVAEVILLVATILLCEKYTQKKKKHSDEGKEFEQIEQLKSDDSNGIENNVPRHRKNESLGQ

SEQ ID NO: 27153 - protein, 561 aa, Homo sapiens
  Payload ID: 5344
  Gene Symbol: EFS
  Gene Name: embryonal Fyn-associated substrate
  Uniprot ID: O43281
  ENSP ID: ENSP00000216733
MAIATSTQLARALYDNTAESPQELSFRRGDVLRVLQREGAGGLDGWCLCSLHGQQGIVPANRVKLLPAGPAPKPSLSPASPAQPGSPYPAPDHSNEDQEVYVVPPPARPCPTSGPPAGPCPPSPDLIYKIPRASGTQLAAPRDALEVYDVPPTALRVPSSGPYDCPASFSHPLTRVAPQPPGEDDAPYDVPLTPKPPAELEPDLEWEGGREPGPPIYAAPSNLKRASALLNLYEAPEELLADGEGGGTDEGIYDVPLLGPEAPPSPEPPGALASHDQDTLAQLLARSPPPPHRPRLPSAESLSRRPLPALPVPEAPSPSPVPSPAPGRKGSIQDRPLPPPPPRLPGYGGPKVEGDPEGREMEDDPAGHHNEYEGIPMAEEYDYVHLKGMDKAQGSRPPDQACTGDPELPERGMPAPQEALSPGEPLVVSTGDLQLLYFYAGQCQSHYSALQAAVAALMSSTQANQPPRLFVPHSKRVVVAAHRLVFVGDTLGRLAASAPLRAQVRAAGTALGQALRATVLAVKGAALGYPSSPAIQEMVQCVTELAGQALQFTTLLTSLAP

SEQ ID NO: 27154 - protein, 468 aa, Homo sapiens
  Payload ID: 5344
  Gene Symbol: EFS
  Gene Name: embryonal Fyn-associated substrate
  Uniprot ID: O43281
  ENSP ID: ENSP00000340607
MAIATSVYVVPPPARPCPTSGPPAGPCPPSPDLIYKIPRASGTQLAAPRDALEVYDVPPTALRVPSSGPYDCPASFSHPLTRVAPQPPGEDDAPYDVPLTPKPPAELEPDLEWEGGREPGPPIYAAPSNLKRASALLNLYEAPEELLADGEGGGTDEGIYDVPLLGPEAPPSPEPPGALASHDQDTLAQLLARSPPPPHRPRLPSAESLSRRPLPALPVPEAPSPSPVPSPAPGRKGSIQDRPLPPPPPRLPGYGGPKVEGDPEGREMEDDPAGHHNEYEGIPMAEEYDYVHLKGMDKAQGSRPPDQACTGDPELPERGMPAPQEALSPGEPLVVSTGDLQLLYFYAGQCQSHYSALQAAVAALMSSTQANQPPRLFVPHSKRVVVAAHRLVFVGDTLGRLAASAPLRAQVRAAGTALGQALRATVLAVKGAALGYPSSPAIQEMVQCVTELAGQALQFTTLLTSLAP

SEQ ID NO: 27155 - protein, 392 aa, Homo sapiens
  Payload ID: 5344
  Gene Symbol: EFS
  Gene Name: embryonal Fyn-associated substrate
  Uniprot ID: O43281
  ENSP ID: ENSP00000416684
MAIATSVYVVPPPARPCPTSGPPAGPCPPSPDLIYKIPRASGTQLAAPRDALEVYDVPPTALRVPSSGPYDCPASFSHPLTRVAPQPPGEDDAPPSPEPPGALASHDQDTLAQLLARSPPPPHRPRLPSAESLSRRPLPALPVPEAPSPSPVPSPAPGRKGSIQDRPLPPPPPRLPGYGGPKVEGDPEGREMEDDPAGHHNEYEGIPMAEEYDYVHLKGMDKAQGSRPPDQACTGDPELPERGMPAPQEALSPGEPLVVSTGDLQLLYFYAGQCQSHYSALQAAVAALMSSTQANQPPRLFVPHSKRVVVAAHRLVFVGDTLGRLAASAPLRAQVRAAGTALGQALRATVLAVKGAALGYPSSPAIQEMVQCVTELAGQALQFTTLLTSLAP

SEQ ID NO: 27156 - protein, 441 aa, Homo sapiens
  Payload ID: 5345
  Gene Symbol: EED
  Gene Name: embryonic ectoderm development
  Uniprot ID: O75530
  ENSP ID: ENSP00000263360
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 27157 - protein, 400 aa, Homo sapiens
  Payload ID: 5345
  Gene Symbol: EED
  Gene Name: embryonic ectoderm development
  Uniprot ID: O75530
  ENSP ID: ENSP00000315587
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSCENAIVCWKPGKMEDDIDKIKPSESNVTILGRFDYSQCDIWYMRFSMDFWQKMLALGNQVGKLYVWDLEVEDPHKAK

SEQ ID NO: 27158 - protein, 466 aa, Homo sapiens
  Payload ID: 5345
  Gene Symbol: EED
  Gene Name: embryonic ectoderm development
  Uniprot ID: O75530
  ENSP ID: ENSP00000338186
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSADYDLLGEKIMSCGMDHSLKLWRINSKRMMNAIKESYDYNPNKTNRPFISQKIHFPDFSTRDIHRNYVDCVRWLGDLILSKSGRAILHSHQQCMRDPVSPNLRQHLSCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 27159 - protein, 361 aa, Homo sapiens
  Payload ID: 5345
  Gene Symbol: EED
  Gene Name: embryonic ectoderm development
  ENSP ID: ENSP00000431778
MSEREVSTAPAGTDMPAAKKQKLSSDENSNPDLSGDENDDAVSIESGTNTERPDTPTNTPNAPGRKSWGKGKWKSKKCKYSFKCVNSLKEDHNQPLFGVQFNWHSKEGDPLVFATVGSNRVTLYECHSQGEIRLLQSYVDADADENFYTCAWTYDSNTSHPLLAVAGSRGIIRIINPITMQCIKHYVGHGNAINELKFHPRDPNLLLSVSKDHALRLWNIQTDTLVAIFGGVEGHRDEVLSASCENAIVCWKPGKMEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 27160 - protein, 115 aa, Homo sapiens
  Payload ID: 5345
  Gene Symbol: EED
  Gene Name: embryonic ectoderm development
  ENSP ID: ENSP00000436084
  MOD_RES (1)..(1): Any amino acid
XEREVSTAPAGTDMPAAKKQKLSSDENSNPDLSGDENSCENAIVCWKPGKMEDDIDKIKPSESNVTILGRFDYSQCDIWYMRFSMDFWQKMLALGNQVGKLYVWDLEVEDPHKAK

SEQ ID NO: 27161 - protein, 106 aa, Homo sapiens
  Payload ID: 5345
  Gene Symbol: EED
  Gene Name: embryonic ectoderm development
  ENSP ID: ENSP00000437318
MEDDIDKIKPSESNVTILGRFDYSQCDIWYMRFSMDFWQKMLALGNQVGKLYVWDLEVEDPHKAKCTTLTHHKCGAAIRQTSFSRDSSILIAVCDDASIWRWDRLR

SEQ ID NO: 27162 - protein, 219 aa, Homo sapiens
  Payload ID: 5346
  Gene Symbol: EMD
  Gene Name: emerin
  ENSP ID: ENSP00000358850
MDNYADLSDTELTTLLRRYNIPHGPVVDLNSTRGDADMYDLPKKEDALLYQSKGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 27163 - protein, 254 aa, Homo sapiens
  Payload ID: 5346
  Gene Symbol: EMD
  Gene Name: emerin
  Uniprot ID: P50402
  ENSP ID: ENSP00000358857
MDNYADLSDTELTTLLRRYNIPHGPVVGSTRRLYEKKIFEYETQRRRLSPPSSSAASSYSFSDLNSTRGDADMYDLPKKEDALLYQSKGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 27164 - protein, 21 aa, Homo sapiens
  Payload ID: 5346
  Gene Symbol: EMD
  Gene Name: emerin
  ENSP ID: ENSP00000401081
MDNYADLSDTELTTLLRRINS

SEQ ID NO: 27165 - protein, 244 aa, Homo sapiens
  Payload ID: 5347
  Gene Symbol: EMG1
  Gene Name: EMG1 N1-specific pseudouridine methyltransferase
  Uniprot ID: Q92979
  ENSP ID: ENSP00000470560
MAAPSDGFKPRERSGGEQAQDWDALPPKRPRLGAGNKIGGRRLIVVLEGASLETVKVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVIKNPVSDHFPVGCMKVGTSFSIPVVSDVRELVPSSDPIVFVVGAFAHGKVSVEYTEKMVSISNYPLSAALTCAKLTTAFEEVWGVI

SEQ ID NO: 27166 - protein, 149 aa, Homo sapiens
  Payload ID: 5347
  Gene Symbol: EMG1
  Gene Name: EMG1 N1-specific pseudouridine methyltransferase
  ENSP ID: ENSP00000479546
  MOD_RES (1)..(1): Any amino acid
XLEGASLETVKVGKTYELLNCDKHKSILLKNGRDPGEARPDITHQSLLMLMDSPLNRAGLLQVYIHTQKNVLIEVNPQTRIPRTFDRFCGLMVQLLHKLSVRAADGPQKLLKVSVEYTEKMVSISNYPLSAALTCAKLTTAFEEVWGVI

SEQ ID NO: 27167 - protein, 443 aa, Homo sapiens
  Payload ID: 5348
  Gene Symbol: EMID1
  Gene Name: EMI domain containing 1
  Uniprot ID: Q96A84
  ENSP ID: ENSP00000335481
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAASSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWGEGLHQLREALKILAERVLILETMIGLYEPELGSGAGPAGTGTPSLLRGKRGGHATNYRIVAPRSRDERG

SEQ ID NO: 27168 - protein, 445 aa, Homo sapiens
  Payload ID: 5348
  Gene Symbol: EMID1
  Gene Name: EMI domain containing 1
  ENSP ID: ENSP00000384452
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAASSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWAPSLQSFLQQQAQLELLARRVTLLEAIIWPEPELGSGAGPAGTGTPSLLRGKRGGHATNYRIVAPRSRDERG

SEQ ID NO: 27169 - protein, 422 aa, Homo sapiens
  Payload ID: 5348
  Gene Symbol: EMID1
  Gene Name: EMI domain containing 1
  ENSP ID: ENSP00000385414
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAASSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGLRGEPGPQGSAGQRGEPGPKGDPGEKSHWGEGLHQLREALKILAERVLILETMIGLYEPELGSGAGPAGTGTPSLLRGKRGGHATNYRIVAPRSRDERG

SEQ ID NO: 27170 - protein, 175 aa, Homo sapiens
  Payload ID: 5348
  Gene Symbol: EMID1
  Gene Name: EMI domain containing 1
  ENSP ID: ENSP00000399760
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEGCLNCSKVSELTERLKVLEAKMTMLTVIEQPVPPTPATPEDPAPLWGPPPAQGSPGDGGLQDQVGAWGL

SEQ ID NO: 27171 - protein, 34 aa, Homo sapiens
  Payload ID: 5348
  Gene Symbol: EMID1
  Gene Name: EMI domain containing 1
  ENSP ID: ENSP00000402621
MGGPRAWALLCLGLLLPGGGAAWSIGAAPFSGRR

SEQ ID NO: 27172 - protein, 212 aa, Homo sapiens
  Payload ID: 5348
  Gene Symbol: EMID1
  Gene Name: EMI domain containing 1
  ENSP ID: ENSP00000403816
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAASSASLEPMWSGSTMRRMALRPTAFSGCLNCSKVSELTERLKVLEAKMTMLTVIEQPVPPTPATPEDPAPLWGPPPAQGSPGDGGLQGDPLLSNTFTETNNHWP

SEQ ID NO: 27173 - protein, 236 aa, Homo sapiens
  Payload ID: 5348
  Gene Symbol: EMID1
  Gene Name: EMI domain containing 1
  ENSP ID: ENSP00000408339
  MOD_RES (1)..(1): Any amino acid
XMTMLTVIEQPVPPTPATPEDPAPLWGPPPAQGSPGDGGLQGLPGAIESVRVPLLPRNDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHW

SEQ ID NO: 27174 - protein, 160 aa, Homo sapiens
  Payload ID: 5349
  Gene Symbol: EBP
  Gene Name: emopamil binding protein (sterol isomerase)
  ENSP ID: ENSP00000390031
MTTNAGPLHPYWPQHLRLDNFVPNDRPTWHILAGLFSVTGVLVVTTWLLSGRAAVVPLGTWRRLSLCWFAVCGFIHLVIEGWFVLYYEDLLGDQAFLSQLWKEYAKGDSRYILGDNFTVCMETITACLWGPLSLWVVIAFLRQHPLRFILQLVVSVGQIY

SEQ ID NO: 27175 - protein, 145 aa, Homo sapiens
  Payload ID: 5349
  Gene Symbol: EBP
  Gene Name: emopamil binding protein (sterol isomerase)
  ENSP ID: ENSP00000405832
MTTNAGPLHPYWPQHLRLDNFVPNDRPTWHILAGLFSVTGVLVVTTWLLSGRAAVVPLGTWRRLSLCWFAVCGFIHLVIEGWFVLYYEDLLGDQAFLSQLWKEYAKGDSRYILGDNFTVCMETITACLWGPLSLWVVIAFLRQHP

SEQ ID NO: 27176 - protein, 230 aa, Homo sapiens [sequence omitted]

SEQ ID NO: 27177 - protein, 206 aa, Homo sapiens
  Payload ID: 5350
  Gene Symbol: EBPL
  Gene Name: emopamil binding protein-like
  Uniprot ID: Q9BY08
  ENSP ID: ENSP00000242827
MGAEWELGAEAGGSLLLCAALLAAGCALGLRLGRGQGAADRGALIWLCYDALVHFALEGPFVYLSLVGNVANSDGLIASLWKEYGKADARWVYFDPTIVSVEILTVALDGSLALFLIYAIVKEKYYRHFLQITLCVCELYGCWMTFLPEWLTRSPNLNTSNWLYCWLYLFFFNGVWVLIPGLLLWQSWLELKKMHQKETSSVKKFQ

SEQ ID NO: 27178 - protein, 152 aa, Homo sapiens
  Payload ID: 5350
  Gene Symbol: EBPL
  Gene Name: emopamil binding protein-like
  Uniprot ID: Q9BY08
  ENSP ID: ENSP00000367516
MGAEWELGAEAGGSLLLCAALLAAGCALGLRLGRGQGAADRGALIWLCYDALVHFALEGPFVYLSLVGNVANSDGLIASLCESRSVPQAGAQWHHLGSLQAPPPRFTPFSCLSLPSSWDYRRPPPRLANFFVFLVETGFHHVSQDGLDLLTS

SEQ ID NO: 27179 - protein, 102 aa, Homo sapiens
  Payload ID: 5350
  Gene Symbol: EBPL
  Gene Name: emopamil binding protein-like
  Uniprot ID: Q9BY08
  ENSP ID: ENSP00000367519
MGAEWELGAEAGGSLLLCAALLAAGCALGLRLGRGQGAADRGALIWLCYDALVHFALAFPADHPVRVRAVWLLDDLPPRVAHQKPQPQHQQLAVLLALPVFF

SEQ ID NO: 27180 - protein, 97 aa, Homo sapiens
  Payload ID: 5350
  Gene Symbol: EBPL
  Gene Name: emopamil binding protein-like
  Uniprot ID: Q9BY08
  ENSP ID: ENSP00000367521
MGAEWELGAEAGGSLLLCAALLAAGCALGLRLGRGQGAADRGALIWLCYDALVHFALEGPFVYLSLVGNVANSDGLIASLCISCRSPCACASCMAAG

SEQ ID NO: 27181 - protein, 134 aa, Homo sapiens
  Payload ID: 5350
  Gene Symbol: EBPL
  Gene Name: emopamil binding protein-like
  ENSP ID: ENSP00000367533
MGAEWELGAEAGGSLLLCAALLAAGCALGLRLGRGQGAADRGALIWLCYDALVHFALEGPFVYLSLVGNVANSDGLIASLWKEYGKADARWVYFDPTIVSVEILTVALDGSLALFLIYAIVKEKYYRDRVAWGE

SEQ ID NO: 27182 - protein, 290 aa, Homo sapiens
  Payload ID: 5351
  Gene Symbol: EMX1
  Gene Name: empty spiracles homeobox 1
  Uniprot ID: Q04741
  ENSP ID: ENSP00000258106
MCLAGCTPRKAAAPGRGALPRARLPRTAPAAATMFQPAAKRGFTIESLVAKDGGTGGGTGGGGAGSHLLAAAASEEPLRPTALNYPHPSAAEAAFVSGFPAAAAAGAGRSLYGGPELVFPEAMNHPALTVHPAHQLGASPLQPPHSFFGAQHRDPLHFYPWVLRNRFFGHRFQASDVPQDGLLLHGPFARKPKRIRTAFSPSQLLRLERAFEKNHYVVGAERKQLAGSLSLSETQVKVWFQNRRTKYKRQKLEEEGPESEQKKKGSHHINRWRIATKQANGEDIDVTSND

SEQ ID NO: 27183 - protein, 147 aa, Homo sapiens
  Payload ID: 5351
  Gene Symbol: EMX1
  Gene Name: empty spiracles homeobox 1
  ENSP ID: ENSP00000446992
MNHPALTVHPAHQLGASPLQPPHSFFGAQHRDPLHFYPWVLRNRFFGHRFQASDVPQDGLLLHGPFARKPKRIRTAFSPSQLLRLERAFEKNHYVVGAERKQLAGSLSLSETQVRRVGVGLSDPQPSCCPGGGFQSLRAGRLPELRE

SEQ ID NO: 27184 - protein, 209 aa, Homo sapiens
  Payload ID: 5351
  Gene Symbol: EMX1
  Gene Name: empty spiracles homeobox 1
  ENSP ID: ENSP00000482619
MGSGYLASFNLSHSVSEALTWSGPPTLEPPEPQRRRGGGSPSAEARRPGPSRSRHRVWALELLPAPRTAGGWQWDRSGGFSRAVPRLAPCEGSERPLSRAVPRDIQKTRNLRNKVAASDRGPGGRCQRRAPGRAASARPLRTQAQADPHGLLALAAAAAGARLREEPLRGGRRAEAAGRQSQPLRDAGEGVVPEPEDKVQTAEAGGGRA

SEQ ID NO: 27185 - protein, 252 aa, Homo sapiens
  Payload ID: 5352
  Gene Symbol: EMX2
  Gene Name: empty spiracles homeobox 2
  Uniprot ID: Q04743
  ENSP ID: ENSP00000450962
MFQPAPKRCFTIESLVAKDSPLPASRSEDPIRPAALSYANSSPINPFLNGFHSAAAAAAGRGVYSNPDLVFAEAVSHPPNPAVPVHPVPPPHALAAHPLPSSHSPHPLFASQQRDPSTFYPWLIHRYRYLGHRFQGNDTSPESFLLHNALARKPKRIRTAFSPSQLLRLEHAFEKNHYVVGAERKQLAHSLSLTETQVKVWFQNRRTKFKRQKLEEEGSDSQQKKKGTHHINRWRIATKQASPEEIDVTSDD

SEQ ID NO: 27186 - protein, 169 aa, Homo sapiens
  Payload ID: 5352
  Gene Symbol: EMX2
  Gene Name: empty spiracles homeobox 2
  Uniprot ID: Q04743
  ENSP ID: ENSP00000474874
MFQPAPKRCFTIESLVAKDSPLPASRSEDPIRPAALSYANSSPINPFLNGFHSAAAAAAGRGVYSNPDLVFAEAVSHPPNPAVPVHPVPPPHALAAHPLPSSHSPHPLFASQQRDPSTFYPWLIHRYRYLGHRFQGKSMVSEPKNKVQKAEAGGRRLRFATKEKRDAPY

SEQ ID NO: 27187 - protein, 69 aa, Homo sapiens
  Payload ID: 5352
  Gene Symbol: EMX2
  Gene Name: empty spiracles homeobox 2
  ENSP ID: ENSP00000480271
SSHSPHPLFASQQRDPSTFYPWLIHRYRYLGHRFQGKSMVSEPKNKVQKAEAGGRRLRFATKEKRDAPY

SEQ ID NO: 27188 - protein, 213 aa, Homo sapiens
  Payload ID: 5353
  Gene Symbol: ENAH
  Gene Name: enabled homolog (Drosophila)
  ENSP ID: ENSP00000284563
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETAQSKVTATQDSTNLRCIFCGPTLPRQNSQLPAQVQNGPSQEELEIQRRQLQEQQRQKELERERLERERMERERLERERLERERLERERLEQEQLERE

SEQ ID NO: 27189 - protein, 570 aa, Homo sapiens
  Payload ID: 5353
  Gene Symbol: ENAH
  Gene Name: enabled homolog (Drosophila)
  Uniprot ID: Q8N8S7
  ENSP ID: ENSP00000355808
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAAAPASVETPLNSVLGDSSASEPGLQAASQPAETPSQQGIVLGPLAPPPPPPLPPGPAQASVALPPPPGPPPPPPLPSTGPPPPPPPPPLPNQVPPPPPPPPAPPLPASGFFLASMSEDNRPLTGLAAAIAGAKLRKVSRMEDTSFPSGGNAIGVNSASSKTDTGRGNGPLPLGGSGLMEEMSALLARRRRIAEKGSTIETEQKEDKGEDSEPVTSKASSTSTPEPTRKPWERTNTMNGSKSPVISRPKSTPLSQPSANGVQTEGLDYDRLKQDILDEMRKELTKLKEELIDAIRQELSKSNTA

SEQ ID NO: 27190 - protein, 591 aa, Homo sapiens
  Payload ID: 5353
  Gene Symbol: ENAH
  Gene Name: enabled homolog (Drosophila)
  Uniprot ID: Q8N8S7
  ENSP ID: ENSP00000355809
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAAAPASVETPLNSVLGDSSASEPGLQAASQPAETPSQQGIVLGPLAPPPPPPLPPGPAQASVALPPPPGPPPPPPLPSTGPPPPPPPPPLPNQVPPPPPPPPAPPLPASGFFLASMSEDNRPLTGLAAAIAGAKLRKVSRMEDTSFPSGGNAIGVNSASSKTDTGRGNGPLPLGGSGLMEEMSALLARRRRIAEKGSTIETEQKEDKGEDSEPVTSKASSTSTPEPTRKPWERTNTMNGSKSPVISRRDSPRKNQIVFDNRSYDSLHRPKSTPLSQPSANGVQTEGLDYDRLKQDILDEMRKELTKLKEELIDAIRQELSKSNTA

SEQ ID NO: 27191 - protein, 242 aa, Homo sapiens
  Payload ID: 5353
  Gene Symbol: ENAH
  Gene Name: enabled homolog (Drosophila)
  ENSP ID: ENSP00000489106
  MOD_RES (1)..(1): Any amino acid
XRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAGKKFTNSSVFLYLSLDDVSCAVMC

SEQ ID NO: 27192 - protein, 802 aa, Homo sapiens
  Payload ID: 5353
  Gene Symbol: ENAH
  Gene Name: enabled homolog (Drosophila)
  ENSP ID: ENSP00000489607
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETVFYLGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAAPSSDSSLYNAPLPEYSSCQPPSAPPPSYAKVISAPVSDATPDYAVVTALPPTSTPPTPPLRHSATRFATSLGSAFHPVLPHYATVPRPLNKNSRPSSPVNTPSSQPPATKPCAWSTSNFSPLPPSPPIMISSPPGKATGPRPVLPVCVSSPVPQMPPSPTAPNGLVDSVTYPVSPPPTSGPAAPPPPPPLPSLASLSHCGSQASPPPSTPIASTPSSKPSVLPSPSAAAPASVETPLNSVLGDSSASEPGLQAASQPAETPSQQGIVLGPLAPPPPPPLPPGPAQASVALPPPPGPPPPPPLPSTGPPPPPPPPPLPNQVPPPPPPPPAPPLPASGFFLASMSEDNRPLTGLAAAIAGAKLRKVSRMEDTSFPSGGNAIGVNSASSKTDTGRGNGPLPLGGSGLMEEMSALLARRRRIAEKGSTIETEQKEDKGEDSEPVTSKASSTSTPEPTRKPWERTNTMNGSKSPVISRPKSTPLSQPSANGVQTEGLDYDRLKQDILDEMRKELTKLKEELIDAIRQELSKSNTA

SEQ ID NO: 27193 - protein, 418 aa, Homo sapiens
  Payload ID: 5354
  Gene Symbol: EVL
  Gene Name: Enah/Vasp-like
  Uniprot ID: Q9UI08
  ENSP ID: ENSP00000376652
MATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRMKPAGSVNDMALDAFDLDRMKQEILEEVVRELHKVKEEIIDAIRQELSGISTT

SEQ ID NO: 27194 - protein, 416 aa, Homo sapiens
  Payload ID: 5354
  Gene Symbol: EVL
  Gene Name: Enah/Vasp-like
  Uniprot ID: Q9UI08
  ENSP ID: ENSP00000384720
MSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRMKPAGSVNDMALDAFDLDRMKQEILEEVVRELHKVKEEIIDAIRQELSGISTT

SEQ ID NO: 27195 - protein, 390 aa, Homo sapiens
  Payload ID: 5354
  Gene Symbol: EVL
  Gene Name: Enah/Vasp-like
  Uniprot ID: Q9UI08
  ENSP ID: ENSP00000437904
MFAFEEFSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRYRTTLLLTCPPGFGAPLSPVP

SEQ ID NO: 27196 - protein, 115 aa, Homo sapiens
  Payload ID: 5354
  Gene Symbol: EVL
  Gene Name: Enah/Vasp-like
  ENSP ID: ENSP00000450723
MVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNG

SEQ ID NO: 27197 - protein, 215 aa, Homo sapiens
  Payload ID: 5354
  Gene Symbol: EVL
  Gene Name: Enah/Vasp-like
  ENSP ID: ENSP00000450979
MLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSS

SEQ ID NO: 27198 - protein, 121 aa, Homo sapiens
  Payload ID: 5354
  Gene Symbol: EVL
  Gene Name: Enah/Vasp-like
  ENSP ID: ENSP00000451226
MATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGDK

SEQ ID NO: 27199 - protein, 104 aa, Homo sapiens
  Payload ID: 5354
  Gene Symbol: EVL
  Gene Name: Enah/Vasp-like
  ENSP ID: ENSP00000451761
  MOD_RES (1)..(1): Any amino acid
XGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQM

SEQ ID NO: 27200 - protein, 212 aa, Homo sapiens
  Payload ID: 5354
  Gene Symbol: EVL
  Gene Name: Enah/Vasp-like
  ENSP ID: ENSP00000451821
PPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRMKPAGSVNDMALDAFDLDRMKQEILEEVVRELHKVKEEIIDAIRQELSGISTT

SEQ ID NO: 27201 - protein, 124 aa, Homo sapiens
  Payload ID: 5354
  Gene Symbol: EVL
  Gene Name: Enah/Vasp-like
  ENSP ID: ENSP00000452156
MATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGACIL

SEQ ID NO: 27202 - protein, 168 aa, Homo sapiens
  Payload ID: 5354
  Gene Symbol: EVL
  Gene Name: Enah/Vasp-like
  ENSP ID: ENSP00000452327
MVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSG

SEQ ID NO: 27203 - protein, 283 aa, Homo sapiens
  Payload ID: 5354
  Gene Symbol: EVL
  Gene Name: Enah/Vasp-like
  ENSP ID: ENSP00000481825
MATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGARKTEPQREEVCTWPKPLPDMTQSGREARMRTCSSSPPVPGSVVGAAWSSRKSACPGAGLRWVCVTLSKSPPPSAGGMTPQARGSSHDTKMPGAWYVAFRAVPHAAPLFVPTSSSFPLNHCRSSQNLLESSCHRLPLLQESRALVALEARPQADGTRPHSGSEF

SEQ ID NO: 27204 - protein, 1142 aa, Homo sapiens
  Payload ID: 5355
  Gene Symbol: ENAM
  Gene Name: enamelin
  Uniprot ID: Q9NRM1
  ENSP ID: ENSP00000379383
MLVLRCRLGTSFPKLDNLVPKGKMKILLVFLGLLGNSVAMPMHMPRMPGFSSKSEEMMRYNQFNFMNGPHMAHLGPFFGNGLPQQFPQYQMPMWPQPPPNTWHPRKSSAPKRHNKTDQTQETQKPNQTQSKKPPQKRPLKQPSHNQPQPEEEAQPPQAFPPFGNGLFPYQQPPWQIPQRLPPPGYGRPPISNEEGGNPYFGYFGYHGFGGRPPYYSEEMFEQDFEKPKEEDPPKAESPGTEPTANSTVTETNSTQPNPKGSQGGNDTSPTGNSTPGLNTGNNPPAQNGIGPLPAVNASGQGGPGSQIPWRPSQPNIRENHPYPNIRNFPSGRQWYFTGTVMGHRQNRPFYRNQQVQRGPRWNFFAWERKQVARPGNPVYHKAYPPTSRGNYPNYAGNPANLRRKPQGPNKHPVGTTVAPLGPKPGPVVRNEKIQNPKEKPLGPKEQIIVPTKNPTSPWRNSQQYEVNKSNYKLPHSEGYMPVPNFNSVDQHENSYYPRGDSRKVPNSDGQTQSQNLPKGIVLGSRRMPYESETNQSELKHSSYQPAVYPEEIPSPAKEHFPAGRNTWDHQEISPPFKEDPGRQEEHLPHPSHGSRGSVFYPEYNPYDPRENSPYLRGNTWDERDDSPNTMGQKESPLYPINTPDQKEIVPYNEEDPVDPTGDEVFPGQNRWGEELSFKGGPTVRHYEGEQYTSNQPKEYLPYSLDNPSKPREDFYYSEFYPWSPDENFPSYNTASTMPPPIESRGYYVNNAAGPEESTLFPSRNSWDHRIQAQGQRERRPYFNRNIWDQATHLQKAPARPPDQKGNQPYYSNTPAGLQKNPIWHEGENLNYGMQITRMNSPEREHSSFPNFIPPSYPSGQKEAHLFHLSQRGSCCAGSSTGPKDNPLALQDYTPSYGLAPGENQDTSPLYTDGSHTKQTRDIISPTSILPGQRNSSEKRESQNPFRDDVSTLRRNTPCSIKNQLGQKEIMPFPEASSLQSKNTPCLKNDLGGDGNNILEQVFEDNQLNERTVDLTPEQLVIGTPDEGSNPEGIQSQVQENESERQQQRPSNILHLPCFGSKLAKHHSSTTGTPSSDGRQSPFDGDSITPTENPNTLVELATEEQFKSINVDPLDADEHSPFEFLQRGTNVQDQVQDCLLLQA

SEQ ID NO: 27205 - protein, 368 aa, Homo sapiens
  Payload ID: 5356
  Gene Symbol: EXOG
  Gene Name: endo/exonuclease (5'-3'), endonuclease G-like
  Uniprot ID: Q9Y2C4
  ENSP ID: ENSP00000287675
MAIKSIASRLRGSRRFLSGFVAGAVVGAAGAGLAALQFFRSQGAEGALTGKQPDGSAEKAVLEQFGFPLTGTEARCYTNHALSYDQAKRVPRWVLEHISKSKIMGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 27206 - protein, 107 aa, Homo sapiens
  Payload ID: 5356
  Gene Symbol: EXOG
  Gene Name: endo/exonuclease (5'-3'), endonuclease G-like
  ENSP ID: ENSP00000394977
MAIKSIASRLRGSRRFLSGFVAGAVVGAAGAGLAALQFFRSQGAEGALTGKQPDGSAEKAVLEQFGFPLTGTEARCYTNHALSYDQAKRVPRWVLEHISKSKIMGWS

SEQ ID NO: 27207 - protein, 187 aa, Homo sapiens
  Payload ID: 5356
  Gene Symbol: EXOG
  Gene Name: endo/exonuclease (5'-3'), endonuclease G-like
  ENSP ID: ENSP00000397124
  MOD_RES (1)..(1): Any amino acid
XFRSQGAEGALTGKQPDGSAEKAVLEQFGFPLTGTEARCYTNHALSYDQAKRVPRWVLEHISKSKIMGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQSWEYPSLQF

SEQ ID NO: 27208 - protein, 56 aa, Homo sapiens
  Payload ID: 5356
  Gene Symbol: EXOG
  Gene Name: endo/exonuclease (5'-3'), endonuclease G-like
  ENSP ID: ENSP00000400239
MAIKSIASRLRGSRRFLSGFVAGAVVGAAGAGLAALQFFRSQGAEGALTGKQPDDC

SEQ ID NO: 27209 - protein, 143 aa, Homo sapiens
  Payload ID: 5356
  Gene Symbol: EXOG
  Gene Name: endo/exonuclease (5'-3'), endonuclease G-like
  ENSP ID: ENSP00000402164
MAIKSIASRLRGSRRFLSGFVAGAVVGAAGAGLAALQFFRSQGAEGALTGKQPDGSAEKAVLEQFGFPLTGTEARCYTNHALSYDQAKRVPRWVLEHISKSKIMGRFFKFTLLASLFLLSLNLHLWLVLNFWVQVTLLPQPPE

SEQ ID NO: 27210 - protein, 318 aa, Homo sapiens
  Payload ID: 5356
  Gene Symbol: EXOG
  Gene Name: endo/exonuclease (5'-3'), endonuclease G-like
  Uniprot ID: Q9Y2C4
  ENSP ID: ENSP00000404305
MAIKSIASRLRGSRRFLSGFVAGAVVGAAGAGLAALQFFRSQGAEGALTGKQPDGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 27211 - protein, 56 aa, Homo sapiens; identical to SEQ ID NO: 27208
  Payload ID: 5356
  Gene Symbol: EXOG
  Gene Name: endo/exonuclease (5'-3'), endonuclease G-like
  ENSP ID: ENSP00000406101

SEQ ID NO: 27212 - protein, 56 aa, Homo sapiens; identical to SEQ ID NO: 27208
  Payload ID: 5356
  Gene Symbol: EXOG
  Gene Name: endo/exonuclease (5'-3'), endonuclease G-like
  ENSP ID: ENSP00000407641

SEQ ID NO: 27213 - protein, 146 aa, Homo sapiens
  Payload ID: 5356
  Gene Symbol: EXOG
  Gene Name: endo/exonuclease (5'-3'), endonuclease G-like
  ENSP ID: ENSP00000412756
MAIKSIASRLRGSRRFLSGFVAGAVVGAAGAGLAALQFFRSQGAEGALTGKQPDGSAEKAVLEQFGFPLTGTEVMQTESIVNLSLIPISLQPSVPSMKIMLEVGGHEDTWLQQEITNFQVKPWLKPFTFLTLCLRILIIILDIGTE

SEQ ID NO: 27214 - protein, 56 aa, Homo sapiens; identical to SEQ ID NO: 27208
  Payload ID: 5356
  Gene Symbol: EXOG
  Gene Name: endo/exonuclease (5'-3'), endonuclease G-like
  ENSP ID: ENSP00000412841

SEQ ID NO: 27215 - protein, 81 aa, Homo sapiens
  Payload ID: 5356
  Gene Symbol: EXOG
  Gene Name: endo/exonuclease (5'-3'), endonuclease G-like
  ENSP ID: ENSP00000413176
MAIKSIASRLRGSRRFLSGFVAGAVVGAAGAGLAALQFFRSQGAEGALTGKQPDGSAEKAVLEQFGFPLTGTEVDSSSLHS

SEQ ID NO: 27216 - protein, 107 aa, Homo sapiens
  Payload ID: 5356
  Gene Symbol: EXOG
  Gene Name: endo/exonuclease (5'-3'), endonuclease G-like
  ENSP ID: ENSP00000415568
RSQGAEGALTGKQPDGSAEKAVLEQFGFPLTGTEVMQTESIVNLSLIPISLQPSVPSMKIMLEVGGHEDTWLQQEITNFQVKPWLKPFTFLTLCLRILIIILDIGTE

SEQ ID NO: 27217 - protein, 15 aa, Homo sapiens
  Payload ID: 5356
  Gene Symbol: EXOG
  Gene Name: endo/exonuclease (5'-3'), endonuclease G-like
  ENSP ID: ENSP00000421649
  MOD_RES (1)..(1): Any amino acid
XGAEGALTGKQPDDC

SEQ ID NO: 27218 - protein, 56 aa, Homo sapiens; identical to SEQ ID NO: 27208
  Payload ID: 5356
  Gene Symbol: EXOG
  Gene Name: endo/exonuclease (5'-3'), endonuclease G-like
  ENSP ID: ENSP00000487559

SEQ ID NO: 27219 - protein, 183 aa, Homo sapiens
  Payload ID: 5357
  Gene Symbol: ENGASE
  Gene Name: endo-beta-N-acetylglucosaminidase
  ENSP ID: ENSP00000300682
  MOD_RES (1)..(1): Any amino acid
XQFFRFDGWLINIENSLSLAAVGNMPPFLRYLTTQLHRQVPGGLVLWYDSVVQSGQLKWQDELNQHNRVFFDSCDGFFTNYNWREEHLERMLGQAGERRADVYVGVDVFARGNVVGGRFDTDKVGGGFRPRASGPVPPLGPHFLMDLPFPSAPQRNDSSCSSQSGDPVALRNRCPAPAKLCPH

SEQ ID NO: 27220 - protein, 365 aa, Homo sapiens
  Payload ID: 5357
  Gene Symbol: ENGASE
  Gene Name: endo-beta-N-acetylglucosaminidase
  ENSP ID: ENSP00000308158
  MOD_RES (1)..(1): Any amino acid
XRRRPGRSIKDEEEETVFREVVSFSPDPLPVRYYDKDTTKPISFYLSSLEELLAWKPRLEDGFNVALEPLACRQPPLSSQRPRTLLCHDMMGGYLDDRFIQGSVVQTPYAFYHWQCIDVFVYFSHHTVTIPPVGWTNTAHRHGVCVLGTFITEWNEGGRLCEAFLAGDERSYQAVADRLVQITQFFRFDGWLINIENSLSLAAVGNMPPFLRYLTTQLHRQVPGGLVLWYDSVVQSGQLKWQDELNQHNRVFFDSCDGFFTNYNWREEHLERMLGQAGERRADVYVGVDVFARGNVVGGRFDTDKVGGGFRPRASGPVPPLGPHFLMDLPFPSAPQRNDSSCSSQSGDPVALRNRCPAPAKLCPH

SEQ ID NO: 27221 - protein, 743 aa, Homo sapiens
  Payload ID: 5357
  Gene Symbol: ENGASE
  Gene Name: endo-beta-N-acetylglucosaminidase
  Uniprot ID: Q8NFI3
  ENSP ID: ENSP00000462333
MEAAAVTVTRSATRRRRRQLQGLAAPEAGTQEEQEDQEPRPRRRRPGRSIKDEEEETVFREVVSFSPDPLPVRYYDKDTTKPISFYLSSLEELLAWKPRLEDGFNVALEPLACRQPPLSSQRPRTLLCHDMMGGYLDDRFIQGSVVQTPYAFYHWQCIDVFVYFSHHTVTIPPVGWTNTAHRHGVCVLGTFITEWNEGGRLCEAFLAGDERSYQAVADRLVQITQFFRFDGWLINIENSLSLAAVGNMPPFLRYLTTQLHRQVPGGLVLWYDSVVQSGQLKWQDELNQHNRVFFDSCDGFFTNYNWREEHLERMLGQAGERRADVYVGVDVFARGNVVGGRFDTDKSLELIRKHGFSVALFAPGWVYECLEKKDFFQNQDKFWGRLERYLPTHSICSLPFVTSFCLGMGARRVCYGQEEAVGPWYHLSAQEIQPLFGEHRLGGDGRGWVRTHCCLEDAWHGGSSLLVRGVIPPEVGNVAVRLFSLQAPVPPKIYLSMVYKLEGPTDVTVALELTTGDAGSCHIGGISVLNAETSSRHSLRPLRVPPTKLARWVGRCGRQLSGGWVQHCYEVSLRGCLLLDLLVCFSRPPGSREEESFTCRLGEIQVVDAASLLAPLPQVQAVTISHIRWQPSASEREGPPALLQLSCTLHWSFLLSQVRCFRIHCWGGMSDDSPGRELPRPEMPMFLGLAFATQYRIVDLLVEAAGPGQDRRMEFLVEPVPKEGFRVPQAEWGRAVLLYSAPA

SEQ ID NO: 27222 - protein, 146 aa, Homo sapiens
  Payload ID: 5357
  Gene Symbol: ENGASE
  Gene Name: endo-beta-N-acetylglucosaminidase
  ENSP ID: ENSP00000463537
MEAAAVTVTRSATRRRRRQLQGLAAPEAGTQEEQEDQEPRPRRRRPGRSIKDEEEETVFREVVSFSPDPLPVRYYDKDTTKPISFYLSSLEELLAWKPRLEDGFNVALEPLACRQPPLSSQRPRTLLCHDMMGGYLDDRDFHHGVE

SEQ ID NO: 27223 - protein, 366 aa, Homo sapiens
  Payload ID: 5358
  Gene Symbol: EBLN1
  Gene Name: endogenous Bornavirus-like nucleoprotein 1
  Uniprot ID: P0CF75
  ENSP ID: ENSP00000473842
MSRPRNNPQTSSPQDSTKDGSSFHYFQGRFELSGKSRQYPADALEPQPGIGDVKVIEKATKSMLDPAQRSHFYLVTPSLVFLCFIFDGLHKALLSVGVSKRSNIVIGNENKETGTLYASKFEDVLPTFTALEMSSILRHCCDLIGIAAGSSDPICTNSLQVQRQFKAMMISIGRPLHSESADLLISYNAGPAIDWINSRPWVGGLMFTFLFGEFESPACELLDQVKVVASKAQMMTYYTVRMFLDQCVDGSTALPAVVLEIPVFEQKKPLAKKVLGDFFEFGGVLRHPVIGVLSPQMFPNLATAANYWAKRRNSTFSGFEALDIIPGSTITFPVLQMASAQKISRGSDMDPYTLNILRGYGISGFE

SEQ ID NO: 27224 - protein, 272 aa, Homo sapiens
  Payload ID: 5359
  Gene Symbol: EBLN2
  Gene Name: endogenous Bornavirus-like nucleoprotein 2
  Uniprot ID: Q6P2I7
  ENSP ID: ENSP00000432104
MGYFLKLYAYVNSHSLFVWVCDRSYKRSFRPMILNKIKELSRNQFSTMSHLRKDSQPSSPGDDAMDRSGLPDLQGRFELSGKNRQYPLDALEPQPSIGDIKDIKKAAKSMLDPAHKSHFHPVTPSLVFLCFIFDGLHQALLSVGVSKRSNTVVGNENEERGTPYASRFKDMPNFIALEKSSVLRHCCDLLIGIAAGSSDKICTSSLQVQRRFKAMMASIGRLSHGESADLLISCNAESAIGWISSRPWVGELMFTLLFGDFESPLHKLRKSS

SEQ ID NO: 27225 - protein, 604 aa, Homo sapiens
  Payload ID: 5360
  Gene Symbol: ERV3-1
  Gene Name: endogenous retrovirus group 3, member 1
  Uniprot ID: Q14264
  ENSP ID: ENSP00000391594
MLGMNMLLITLFLLLPLSMLKGEPWEGCLHCTHTTWSGNIMTKTLLYHTYYECAGTCLGTCTHNQTTYSVCDPGRGQPYVCYDPKSSPGTWFEIHVGSKEGDLLNQTKVFPSGKDVVSLYFDVCQIVSMGSLFPVIFSSMEYYSSCHKNRYAHPACSTDSPVTTCWDCTTWSTNQQSLGPIMLTKIPLEPDCKTSTCNSVNLTILEPDQPIWTTGLKAPLGARVSGEEIGPGAYVYLYIIKKTRTRSTQQFRVFESFYEHVNQKLPEPPPLASNLFAQLAENIASSLHVASCYVCGGMNMGDQWPWEARELMPQDNFTLTASSLEPAPSSQSIWFLKTSIIGKFCIARWGKAFTDPVGELTCLGQQYYNETLGKTLWRGKSNNSESPHPSPFSRFPSLNHSWYQLEAPNTWQAPSGLYWICGPQAYRQLPAKWSGACVLGTIRPSFFLMPLKQGEALGYPIYDETKRKSKRGITIGDWKDNEWPPERIIQYYGPATWAEDGMWGYRTPVYMLNRIIRLQAVLEIITNETAGALNLLAQQATKMRNVIYQNRLALDYLLAQEEGVCGKFNLTNCCLELDDEGKVIKEITAKIQKLAHIPVQTWKG

SEQ ID NO: 27226 - protein, 538 aa, Homo sapiens
  Payload ID: 5361
  Gene Symbol: ERVFRD-1
  Gene Name: endogenous retrovirus group FRD, member 1
  Uniprot ID: P60508
  ENSP ID: ENSP00000420174
MGLLLLVLILTPSLAAYRHPDFPLLEKAQQLLQSTGSPYSTNCWLCTSSSTETPGTAYPASPREWTSIEAELHISYRWDPNLKGLMRPANSLLSTVKQDFPDIRQKPPIFGPIFTNINLMGIAPICVMAKRKNGTNVGTLPSTVCNVTFTVDSNQQTYQTYTHNQFRHQPRFPKPPNITFPQGTLLDKSSRFCQGRPSSCSTRNFWFRPADYNQCLQISNLSSTAEWVLLDQTRNSLFWENKTKGANQSQTPCVQVLAGMTIATSYLGISAVSEFFGTSLTPLFHFHISTCLKTQGAFYICGQSIHQCLPSNWTGTCTIGYVTPDIFIAPGNLSLPIPIYGNSPLPRVRRAIHFIPLLAGLGILAGTGTGIAGITKASLTYSQLSKEIANNIDTMAKALTTMQEQIDSLAAVVLQNRRGLDMLTAAQGGICLALDEKCCFWVNQSGKVQDNIRQLLNQASSLRERATQGWLNWEGTWKWFSWVLPLTGPLVSLLLLLLFGPCLLNLITQFVSSRLQAIKLQTNLSAGRHPRNIQESPF

SEQ ID NO: 27227 - protein, 538 aa, Homo sapiens; identical to SEQ ID NO: 27226
  Payload ID: 5361
  Gene Symbol: ERVFRD-1
  Gene Name: endogenous retrovirus group FRD, member 1
  Uniprot ID: P60508
  ENSP ID: ENSP00000444461

SEQ ID NO: 27228 - protein, 74 aa, Homo sapiens
  Payload ID: 5362
  Gene Symbol: ERVK3-1
  Gene Name: endogenous retrovirus group K3, member 1
  ENSP ID: ENSP00000488921
MSQRNLNAKTEQGPTGVTMTSNPITWGQIKKTTQEAEKLLERQGQAKTPDSMFLAMLAVVSCASIGSGEPPTGN

SEQ ID NO: 27229 - protein, 109 aa, Homo sapiens
  Payload ID: 5362
  Gene Symbol: ERVK3-1
  Gene Name: endogenous retrovirus group K3, member 1
  ENSP ID: ENSP00000489018
MDKPCGCPPGVCDHGTGDRRDPWYSTVGLLPPVRAMSQRNLNAKTEQGPTGVTMTSNPITWGQIKKTTQEAEKLLERQGQAKTPDSMFLAMLAVVSCASIGSGEPPTGN

SEQ ID NO: 27230 - protein, 79 aa, Homo sapiens
  Payload ID: 5362
  Gene Symbol: ERVK3-1
  Gene Name: endogenous retrovirus group K3, member 1
  ENSP ID: ENSP00000489068
MLVFLQEMDKPCGCPPGVCDHGTGDRRDPWYSTVGLLPPVRAMSQRNLNAKTEQGPTGVTMTSNPITWGQIKKTTQEAE

SEQ ID NO: 27231 - protein, 85 aa, Homo sapiens
  Payload ID: 5362
  Gene Symbol: ERVK3-1
  Gene Name: endogenous retrovirus group K3, member 1
  ENSP ID: ENSP00000489088
MLPLFIFLISDLTHNFLGPLSLDPSRTTLATARGKEEMDKPCGCPPGVCDHGTGDRRDPWYSTVGLLPPVRAMSQRNLNAKTEQG

SEQ ID NO: 27232 - protein, 98 aa, Homo sapiens
  Payload ID: 5362
  Gene Symbol: ERVK3-1
  Gene Name: endogenous retrovirus group K3, member 1
  ENSP ID: ENSP00000489148
MDKPCGCPPGVCDHGTGDRRDPWYSTVGLLPPVRAMSQRNLNAKTEQGPTGVTMTSNPITWGQIKKTTQEAEKLLERQGQAKTPDSMFLAMLAVVSCA

SEQ ID NO: 27233 - protein, 116 aa, Homo sapiens
  Payload ID: 5362
  Gene Symbol: ERVK3-1
  Gene Name: endogenous retrovirus group K3, member 1
  ENSP ID: ENSP00000489180
MLVFLQEMDKPCGCPPGVCDHGTGDRRDPWYSTVGLLPPVRAMSQRNLNAKTEQGPTGVTMTSNPITWGQIKKTTQEAEKLLERQGQAKTPDSMFLAMLAVVSCASIGSGEPPTGN

SEQ ID NO: 27234 - protein, 563 aa, Homo sapiens
  Payload ID: 5363
  Gene Symbol: ERVMER34-1
  Gene Name: endogenous retrovirus group MER34, member 1
  Uniprot ID: Q9H9K5
  ENSP ID: ENSP00000460255
MGSLSNYALLQLTLTAFLTILVQPQHLLAPVFRTLSILTNQSNCWLCEHLDNAEQPELVFVPASASTWWTYSGQWMYERVWYPQAEVQNHSTSSYRKVTWHWEASMEAQGLSFAQVRLLEGNFSLCVENKNGSGPFLGNIPKQYCNQILWFDSTDGTFMPSIDVTNESRNDDDDTSVCLGTRQCSWFAGCTNRTWNSSAVPLIGLPNTQDYKWVDRNSGLTWSGNDTCLYSCQNQTKGLLYQLFRNLFCSYGLTEAHGKWRCADASITNDKGHDGHRTPTWWLTGSNLTLSVNNSGLFFLCGNGVYKGFPPKWSGRCGLGYLVPSLTRYLTLNASQITNLRSFIHKVTPHRCTQGDTDNPPLYCNPKDNSTIRALFPSLGTYDLEKAILNISKAMEQEFSATKQTLEAHQSKVSSLASASRKDHVLDIPTTQRQTACGTVGKQCCLYINYSEEIKSNIQRLHEASENLKNVPLLDWQGIFAKVGDWFRSWGYVLLIVLFCLFIFVLIYVRVFRKSRRSLNSQPLNLALSPQQSAQLLVSETSCQVSNRAMKGLTTHQYDTSLL

SEQ ID NO: 27235 - protein, 563 aa, Homo sapiens; identical to SEQ ID NO: 27234
  Payload ID: 5363
  Gene Symbol: ERVMER34-1
  Gene Name: endogenous retrovirus group MER34, member 1
  Uniprot ID: Q9H9K5
  ENSP ID: ENSP00000460602

SEQ ID NO: 27236 - protein, 477 aa, Homo sapiens
  Payload ID: 5364
  Gene Symbol: ERVV-1
  Gene Name: endogenous retrovirus group V, member 1
  Uniprot ID: B6SEH8
  ENSP ID: ENSP00000473153
MTEKFLFLYLSLLPMPLLSQAQWNENSLVSFSKIIASGNHLSNCWICHNFITRSSSYQYILVRNFSLNLTFGSGIPEGQHKSVPLQVSLANSAHQVPCLDLTPPFNQSSKTSFYFYNCSSLNQTCCPCPEGHCDRKNTSEEGFPSPTIHPMSFSPAGCHPNLTHWCPAKQMNDYRDKSPQNRCAAWEGKELITWRVLYLLPKAHTVPTWPKSTVPLGGPLSPACNQTIPAGWKSQLHKWFDSHIPRWACTPPGYVFLCGPQKNKLPFDGSPKITYSTPPVANLYTCINNIQHTGECAVGLLGPRGIGVTIYNTTQPRQKRALGLILAGMGAAIGMIAPWGGFTYHDVTLRNLSRQIDNIAKSTRDSISKLKASIDSLANVVMNNRLALDYLLAEQGGVCAVISKSCCIYVNNSGAIEEDIKKIYDEVTWLHNFGKGDSAGSIWEAVKSALPSLTWFVPLLGPAALNSLLSPLWPLSL

SEQ ID NO: 27237 - protein, 535 aa, Homo sapiens
  Payload ID: 5365
  Gene Symbol: ERVV-2
  Gene Name: endogenous retrovirus group V, member 2
  Uniprot ID: B6SEH9
  ENSP ID: ENSP00000472919
MTEKFLFLYLSLLPMPLLSQAQWNENSLVSFSKIIASGNHLSNCWICHNFITRSSSYQYILVRNFSLNLTFGSGIPEGQHKSVPLQVSLANSAHQVPCLDLTPPFNQSSKTSFYFYNCSSLNQTCCPCPEGHCDRKNTSEEGFPSPTIHPMSFSPAGCHPNLTHWCPAKQMNDYRDKSPQNRCAAWEGKELITWRVLYSLPKAHTVPTWPKSTVPLGGPLSPACNQTIPAGWKSQLHKWFDSHIPRWACTPPGYVFLCGPQKNKLPFDGSPKITYSTPPVANLYTCINNIQHTGECAVGLLGPRGIGVTIYNTTQPRQKRALGLILAGMGAAIGMIAPWGGFTYHDVTLRNLSRQIDNIAKSTRDSISKLKASIDSLANVVMDNRLALDYLLAEQGGVCAVINKSCCVYVNNSGAIEEDIKKIYDEATWLHDFGKGGASARAIWEAVKSALPSLNWFVPLLGPATVILLLFLFGPCFFNLLIKCVSSRIKQFHMKSPQMERYQLSVIGGPSTYKHISPLDASGQRFRETMEEFSL

SEQ ID NO: 27238 - protein, 538 aa, Homo sapiens
  Payload ID: 5366
  Gene Symbol: ERVW-1
  Gene Name: endogenous retrovirus group W, member 1
  Uniprot ID: Q9UQF0
  ENSP ID: ENSP00000419945
MALPYHIFLFTVLLPSFTLTAPPPCRCMTSSSPYQEFLWRMQRPGNIDAPSYRSLSKGTPTFTAHTHMPRNCYHSATLCMHANTHYWTGKMINPSCPGGLGVTVCWTYFTQTGMSDGGGVQDQAREKHVKEVISQLTRVHGTSSPYKGLDLSKLHETLRTHTRLVSLFNTTLTGLHEVSAQNPTNCWICLPLNFRPYVSIPVPEQWNNFSTEINTTSVLVGPLVSNLEITHTSNLTCVKFSNTTYTTNSQCIRWVTPPTQIVCLPSGIFFVCGTSAYRCLNGSSESMCFLSFLVPPMTIYTEQDLYSYVISKPRNKRVPILPFVIGAGVLGALGTGIGGITTSTQFYYKLSQELNGDMERVADSLVTLQDQLNSLAAVVLQNRRALDLLTAERGGTCLFLGEECCYYVNQSGIVTEKVKEIRDRIQRRAEELRNTGPWGLLSQWMPWILPFLGPLAAIILLLLFGPCIFNLLVNFVSSRIEAVKLQMEPKMQSKTKIYRRPLDRPASPRSDVNDIKGTPPEEISAAQPLLRPNSAGSS

SEQ ID NO: 27239 - protein, 538 aa, Homo sapiens; identical to SEQ ID NO: 27238
  Payload ID: 5366
  Gene Symbol: ERVW-1
  Gene Name: endogenous retrovirus group W, member 1
  Uniprot ID: Q9UQF0
  ENSP ID: ENSP00000474984

SEQ ID NO: 27240 - protein, 625 aa, Homo sapiens
  Payload ID: 5367
  Gene Symbol: ENG
  Gene Name: endoglin
  Uniprot ID: P17813
  ENSP ID: ENSP00000341917
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTREYPRPPQ

SEQ ID NO: 27241 - protein, 658 aa, Homo sapiens
  Payload ID: 5367
  Gene Symbol: ENG
  Gene Name: endoglin
  Uniprot ID: P17813
  ENSP ID: ENSP00000362299
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 27242 - protein, 476 aa, Homo sapiens
  Payload ID: 5367
  Gene Symbol: ENG
  Gene Name: endoglin
  ENSP ID: ENSP00000479015
MLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 27243 - protein, 261 aa, Homo sapiens
  Payload ID: 5368
  Gene Symbol: EMCN
  Gene Name: endomucin
  Uniprot ID: Q9ULC0
  ENSP ID: ENSP00000296420
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 27244 - protein, 178 aa, Homo sapiens
  Payload ID: 5368
  Gene Symbol: EMCN
  Gene Name: endomucin
  Uniprot ID: Q9ULC0
  ENSP ID: ENSP00000304780
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGTPENGNDQPQSDKESVKLLTVKTISHESGEHSAQGKTKN

SEQ ID NO: 27245 - protein, 248 aa, Homo sapiens
  Payload ID: 5368
  Gene Symbol: EMCN
  Gene Name: endomucin
  Uniprot ID: Q9ULC0
  ENSP ID: ENSP00000422432
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKSSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 27246 - protein, 76 aa, Homo sapiens
  Payload ID: 5368
  Gene Symbol: EMCN
  Gene Name: endomucin
  ENSP ID: ENSP00000426515
LMSTATFLTSKDEGLKATTTDVRKNDSIISNVTVTSVTLPNAVSTLQSSKPKTETQSSIKTTEIPGEHSAQGKTKN

SEQ ID NO: 27247 - protein, 165 aa, Homo sapiens
  Payload ID: 5368
  Gene Symbol: EMCN
  Gene Name: endomucin
  ENSP ID: ENSP00000427608
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGIILPVVIALIVITLSVFVLVGLYRMC

SEQ ID NO: 27248 - protein, 500 aa, Homo sapiens
  Payload ID: 5369
  Gene Symbol: ENDOD1
  Gene Name: endonuclease domain containing 1
  Uniprot ID: O94919
  ENSP ID: ENSP00000278505
MGTARWLALGSLFALAGLLEGRLVGEEEAGFGECDKFFYAGTPPAGLAADSHVKICQRAEGAERFATLYSTRDRIPVYSAFRAPRPAPGGAEQRWLVEPQIDDPNSNLEEAINEAEAITSVNSLGSKQALNTDYLDSDYQRGQLYPFSLSSDVQVATFTLTNSAPMTQSFQERWYVNLHSLMDRALTPQCGSGEDLYILTGTVPSDYRVKDKVAVPEFVWLAACCAVPGGGWAMGFVKHTRDSDIIEDVMVKDLQKLLPFNPQLFQNNCGETEQDTEKMKKILEVVNQIQDEERMVQSQKSSSPLSSTRSKRSTLLPPEASEGSSSFLGKLMGFIATPFIKLFQLIYYLVVAILKNIVYFLWCVTKQVINGIESCLYRLGSATISYFMAIGEELVSIPWKVLKVVAKVIRALLRILCCLLKAICRVLSIPVRVLVDVATFPVYTMGAIPIVCKDIALGLGGTVSLLFDTAFGTLGGLFQVVFSVCKRIGYKVTFDNSGEL

SEQ ID NO: 27249 - protein, 297 aa, Homo sapiens
  Payload ID: 5370
  Gene Symbol: ENDOG
  Gene Name: endonuclease G
  Uniprot ID: Q14249
  ENSP ID: ENSP00000361725
MRALRAGLTLASGAGLGAVVEGWRRRREDARAAPGLLGRLPVLPVAAAAELPPVPGGPRGPGELAKYGLPGLAQLKSRESYVLCYDPRTRGALWVVEQLRPERLRGDGDRRECDFREDDSVHAYHRATNADYRGSGFDRGHLAAAANHRWSQKAMDDTFYLSNVAPQVPHLNQNAWNNLEKYSRSLTRSYQNVYVCTGPLFLPRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 27250 - protein, 264 aa, Homo sapiens
  Payload ID: 5371
  Gene Symbol: ENDOV
  Gene Name: endonuclease V
  Uniprot ID: Q8N8Q3
  ENSP ID: ENSP00000317810
MALEAAGGPPEETLSLWKREQARLKAHVVDRDTEAWQRDPAFSGLQRVGGVDVSFVKGDSVRACASLVVLSFPELEVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSGEGQPPQDHSPGPRTAPRPGSQEQAGKDWQ

SEQ ID NO: 27251 - protein, 105 aa, Homo sapiens
  Payload ID: 5371
  Gene Symbol: ENDOV
  Gene Name: endonuclease V
  ENSP ID: ENSP00000427921
MALEAAGGPPEETLSLWKREQARLKAHVVDRDTEAWQRDPAFSGLQRVGGVDVSFVKGDSVRACASLVVLSFPELEFCLQVAKQNGSSLPSACQPFCCWKQLPAP

SEQ ID NO: 27252 - protein, 236 aa, Homo sapiens
  Payload ID: 5371
  Gene Symbol: ENDOV
  Gene Name: endonuclease V
  ENSP ID: ENSP00000428283
MVSLTAPYVSGFLAFREVPFLLELVQQLREKEPGLMPQVLLVDGNGVLHHRGFGVACHLGVLTDLPCVGVAKKLLQVDGLENNALHKEKIRLLQTRGDSFPLLGDSGTVLGMPTGQPSPSLSQALRSHDRSTRPLYISVGHRMSLEAAVRLTCCCCRFRIPEPVRQADICSREHIRKSLGLPGPPTPRSPKAQRPVACPKGDSGESSGGAPSPQRQADRTTPGGRRSTAQHQVGQR

SEQ ID NO: 27253 - protein, 97 aa, Homo sapiens
  Payload ID: 5371
  Gene Symbol: ENDOV
  Gene Name: endonuclease V
  ENSP ID: ENSP00000429183
MALEAAGGPPEETLSLWKREQARLKAHVVDRDTEAWQRDPAFSGLQRVGGVDVSFVKGDSVRACASLVVLSFPELEGWPCPEGRGAAQLTVTLPVAP

SEQ ID NO: 27254 - protein, 282 aa, Homo sapiens
  Payload ID: 5371
  Gene Symbol: ENDOV
  Gene Name: endonuclease V
  Uniprot ID: Q8N8Q3
  ENSP ID: ENSP00000429190
MALEAAGGPPEETLSLWKREQARLKAHVVDRDTEAWQRDPAFSGLQRVGGVDVSFVKGDSVRACASLVVLSFPELEVVYEESRMVSLTAPYVSGFLAFREVPFLLELVQQLREKEPGLMPQVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSALC

SEQ ID NO: 27255 - protein, 138 aa, Homo sapiens
  Payload ID: 5371
  Gene Symbol: ENDOV
  Gene Name: endonuclease V
  ENSP ID: ENSP00000429442
MALEAAGGPPEETLSLWKREQARLKAHVVDRDTEAWQRDPAFSGLQRVGGVDVSFVKGDSVRACASLVVLSFPELEALGWPATLASLQTCRVLGWPRNFCRWMGWRTTPCTRRRSDSCRLEETHSLCWETLGLSWEWP

SEQ ID NO: 27256 - protein, 50 aa, Homo sapiens
  Payload ID: 5371
  Gene Symbol: ENDOV
  Gene Name: endonuclease V
  ENSP ID: ENSP00000429603
MVSLTAPYVSGFLAFREVPFLLELVQQLREKEPGLMPQVLLVDGNGVLHH

SEQ ID NO: 27257 - protein, 123 aa, Homo sapiens
  Payload ID: 5371
  Gene Symbol: ENDOV
  Gene Name: endonuclease V
  ENSP ID: ENSP00000430046
MALEAAGGPPEETLSLWKRLWGGLPPWRPYRPAVCWGGQETSAGGWAGEQRPAQGEDPTPADSRRLIPSAGRLWDCPGNGPEEPRPQHQAPLHLRGPQDEPGGRCAPDLLLLQVPDPRARAPG

SEQ ID NO: 27258 - protein, 131 aa, Homo sapiens
  Payload ID: 5371
  Gene Symbol: ENDOV
  Gene Name: endonuclease V
  ENSP ID: ENSP00000430509
  MOD_RES (1)..(1): Any amino acid
XFGVACHLGVLTDLPCVGVAKKLLQVDGLENNALHKEKIRLLQTRGDSFPLLGDSGTVLGMADICSREHIRKSLGLPGPPTPRSPKAQRPVACPKGDSGESSGGAPSPQRQADRTTPGGRRSTAQHQVGQR

SEQ ID NO: 27259 - protein, 170 aa, Homo sapiens
  Payload ID: 5371
  Gene Symbol: ENDOV
  Gene Name: endonuclease V
  ENSP ID: ENSP00000430639
HDRSTRPLYISVGHRMSLEAAVRLTCCCCRFRIPEPVRQVHLLLCSRRSWESTDGVSVGLLSPWLRAGPSWWPHGHRRCGAPGCQVQALLPGQAGPLQGKADICSREHIRKSLGLPGPPTPRSPKAQRPVACPKGDSGESSGGAPSPQRQADRTTPGGRRSTAQHQVGQR

SEQ ID NO: 27260 - protein, 237 aa, Homo sapiens
  Payload ID: 5371
  Gene Symbol: ENDOV
  Gene Name: endonuclease V
  Uniprot ID: Q8N8Q3
  ENSP ID: ENSP00000431036
MALEAAGGPPEETLSLWKREQARLKAHVVDRDTEAWQRDPAFSGLQRVGGVDVSFVKGDSVRACASLVVLSFPELEVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSALC

SEQ ID NO: 27261 - protein, 115 aa, Homo sapiens
  Payload ID: 5371
  Gene Symbol: ENDOV
  Gene Name: endonuclease V
  ENSP ID: ENSP00000458185
MALRSHDRSTRPLYISVGHRMSLEAAVRLTCCCCRFRIPEPVRQADICSREHIRKSLGLPGPPTPRSPKAQRPVACPKGDSGESSGEGQPPQDHSPGPRTAPRPGSQEQAGKDWQ

SEQ ID NO: 27262 - protein, 65 aa, Homo sapiens
  Payload ID: 5371
  Gene Symbol: ENDOV
  Gene Name: endonuclease V
  Uniprot ID: Q8N8Q3
  ENSP ID: ENSP00000458361
MALRSHDRSTRPLYISVGHRMSLEAAVRLTCCCCRFRIPEPVRQHFVERGGESTRPRLIPDRTRW

SEQ ID NO: 27263 - protein, 65 aa, Homo sapiens; identical to SEQ ID NO: 27262
  Payload ID: 5371
  Gene Symbol: ENDOV
  Gene Name: endonuclease V
  Uniprot ID: Q8N8Q3
  ENSP ID: ENSP00000458391

SEQ ID NO: 27264 - protein, 97 aa, Homo sapiens
  Payload ID: 5371
  Gene Symbol: ENDOV
  Gene Name: endonuclease V
  ENSP ID: ENSP00000459127
MVSLTAPYVSGFLAFREVPFLLELVQQLREKEPGLMPQVLLVDGNGVLHHRGFGVACHLGVLTDLPCVGVAKKLLQVDGLENNALHKEKIRLLQTRG

SEQ ID NO: 27265 - protein, 8 aa, Homo sapiens
  Payload ID: 5371
  Gene Symbol: ENDOV
  Gene Name: endonuclease V
  ENSP ID: ENSP00000459831
MALRSHDR

SEQ ID NO: 27266 - protein, 88 aa, Homo sapiens
  Payload ID: 5371
  Gene Symbol: ENDOV
  Gene Name: endonuclease V
  Uniprot ID: Q8N8Q3
  ENSP ID: ENSP00000460685
MALRSHDRSTRPLYISVGHRMSLEAAVRLTCCCCRFRIPEPVRQADICSREHIRKSLGLPGPPTPRSPKAQRPVACPKGDSGESSALC

SEQ ID NO: 27267 - protein, 105 aa, Homo sapiens
  Payload ID: 5371
  Gene Symbol: ENDOV
  Gene Name: endonuclease V
  ENSP ID: ENSP00000461060
MVSLTAPYVSGFLAFREVPFLLELVQQLREKEPGLMPQVLLVDGNGVLHHRGFGVACHLGVLTDLPCVGVAKKLLQVDGLENNALHKEKLSGACMEKLLNKNLLS

SEQ ID NO: 27268 - protein, 3 aa, Homo sapiens
  Payload ID: 5371
  Gene Symbol: ENDOV
  Gene Name: endonuclease V
  ENSP ID: ENSP00000461194
MAL

SEQ ID NO: 27269 - protein, 109 aa, Homo sapiens
  Payload ID: 5371
  Gene Symbol: ENDOV
  Gene Name: endonuclease V
  ENSP ID: ENSP00000461376
  MOD_RES (1)..(1): Any amino acid
XVGVAKKLLQVDGLENNALHKEKVPQPPGPPPAKTCLELPPTLFLPHLPLHLPPLGPHVGTGSETLTMEGAVDTPSCFTGWQILRAETVSLIPPSSQVPAWRSCLIKIC

SEQ ID NO: 27270 - protein, 155 aa, Homo sapiens
  Payload ID: 5371
  Gene Symbol: ENDOV
  Gene Name: endonuclease V
  ENSP ID: ENSP00000461563
MVSLTAPYVSGFLAFREVPFLLELVQQLREKEPGLMPQVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQ

SEQ ID NO: 27271 - protein, 88 aa, Homo sapiens; identical to SEQ ID NO: 27266
  Payload ID: 5371
  Gene Symbol: ENDOV
  Gene Name: endonuclease V
  Uniprot ID: Q8N8Q3
  ENSP ID: ENSP00000461577

SEQ ID NO: 27272 - protein, 369 aa, Homo sapiens
  Payload ID: 5372
  Gene Symbol: ENDOU
  Gene Name: endonuclease, polyU-specific
  Uniprot ID: P21128
  ENSP ID: ENSP00000229003
MRACISLVLAVLCGLAWAEDHKESEPLPQLEEETEEALASNLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 27273 - protein, 410 aa, Homo sapiens
  Payload ID: 5372
  Gene Symbol: ENDOU
  Gene Name: endonuclease, polyU-specific
  Uniprot ID: P21128
  ENSP ID: ENSP00000397679
MRACISLVLAVLCGLAWAGKIESCASRCNEKFNRDAACQCDRRCLWHGNCCEDYEHLCTEDHKESEPLPQLEEETEEALASNLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 27274 - protein, 347 aa, Homo sapiens
  Payload ID: 5372
  Gene Symbol: ENDOU
  Gene Name: endonuclease, polyU-specific
  Uniprot ID: P21128
  ENSP ID: ENSP00000445004
MRACISLVLAVLCGLAWADLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 27275 - protein, 569 aa, Homo sapiens
  Payload ID: 5373
  Gene Symbol: EEPD1
  Gene Name: endonuclease/exonuclease/phosphatase family domain containing 1
  Uniprot ID: Q7L9B9
  ENSP ID: ENSP00000242108
MGSTLGCHRSIPRDPSDLSHSRKFSAACNFSNILVNQERLNINTATEEELMTLPGVTRAVARSIVEYREYIGGFKKVEDLALVSGVGATKLEQVKFEICVSSKGSSAQHSPSSLRRDLLAEQQPHHLATAVPLTPRVNINTATPAQLMSVRGLSEKMALSIVDFRREHGPFRSVEDLVRMDGINAAFLDRIRHQVFAERSRPPSTHTNGGLTFTAKPHPSPTSLSLQSEDLDLPPGGPTQIISTRPSVEAFGGTRDGRPVLRLATWNLQGCSVEKANNPGVREVVCMTLLENSIKLLAVQELLDREALEKFCTELNQPTLPNIRKWKGPRGCWKAVVAEKPSSQLQKGAGYAGFLWDAAAGMELRDAGSQESSPSNGHGKLAGPSPYLGRFKVGSHDLTLVNLHLAALTLLGSENPSKNHSDGHRLASFAQTLQETLKGEKDVIILGDFGQGPDSNDYDILRKEKFHHLIPAHTFTNISTKNPQGSKSLDNIWISKSLKKVFTGHWAVVREGLTNPWIPDNWSWGGVASEHCPVLAEFYTEKDWSKKDAPRNGSGVALERSEANIKHER

SEQ ID NO: 27276 - protein, 34 aa, Homo sapiens
  Payload ID: 5373
  Gene Symbol: EEPD1
  Gene Name: endonuclease/exonuclease/phosphatase family domain containing 1
  ENSP ID: ENSP00000416373
  MOD_RES (1)..(1): Any amino acid
XDNIWISKSLKKDAPRNGSGVALERSEANIKHER

SEQ ID NO: 27277 - protein, 569 aa, Homo sapiens; identical to SEQ ID NO: 27275
  Payload ID: 5373
  Gene Symbol: EEPD1
  Gene Name: endonuclease/exonuclease/phosphatase family domain containing 1
  Uniprot ID: Q7L9B9
  ENSP ID: ENSP00000442692

SEQ ID NO: 27278 - protein, 948 aa, Homo sapiens
  Payload ID: 5374
  Gene Symbol: ERAP1
  Gene Name: endoplasmic reticulum aminopeptidase 1
  Uniprot ID: Q9NZ08
  ENSP ID: ENSP00000296754
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITMTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQKGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSERMLRSQLLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLEHDPEADATG

SEQ ID NO: 27279 - protein, 941 aa, Homo sapiens
  Payload ID: 5374
  Gene Symbol: ERAP1
  Gene Name: endoplasmic reticulum aminopeptidase 1
  Uniprot ID: Q9NZ08
  ENSP ID: ENSP00000406304
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITMTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQKGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSERMLRSQLLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLERM

SEQ ID NO: 27280 - protein, 129 aa, Homo sapiens
  Payload ID: 5374
  Gene Symbol: ERAP1
  Gene Name: endoplasmic reticulum aminopeptidase 1
  ENSP ID: ENSP00000421697
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQE

SEQ ID NO: 27281 - protein, 9 aa, Homo sapiens
  Payload ID: 5374
  Gene Symbol: ERAP1
  Gene Name: endoplasmic reticulum aminopeptidase 1
  ENSP ID: ENSP00000422631
MAFPCFDEP

SEQ ID NO: 27282 - protein, 144 aa, Homo sapiens
  Payload ID: 5374
  Gene Symbol: ERAP1
  Gene Name: endoplasmic reticulum aminopeptidase 1
  ENSP ID: ENSP00000425381
  MOD_RES (1)..(1): Any amino acid
XKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLERVALQRKPKCWVPCHRRIKYLILLIL

SEQ ID NO: 27283 - protein, 1 aa, Homo sapiens
  Payload ID: 5374
  Gene Symbol: ERAP1
  Gene Name: endoplasmic reticulum aminopeptidase 1
  ENSP ID: ENSP00000427025
M

SEQ ID NO: 27284 - protein, 915 aa, Homo sapiens
  Payload ID: 5375
  Gene Symbol: ERAP2
  Gene Name: endoplasmic reticulum aminopeptidase 2
  Uniprot ID: Q6P179
  ENSP ID: ENSP00000369235
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVKLFFESLEAQGSHLDIFQTVLETITKNIKWLEKNLPTLRTWLMVNT

SEQ ID NO: 27285 - protein, 960 aa, Homo sapiens
  Payload ID: 5375
  Gene Symbol: ERAP2
  Gene Name: endoplasmic reticulum aminopeptidase 2
  Uniprot ID: Q6P179
  ENSP ID: ENSP00000400376
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVKLFFESLEAQGSHLDIFQTVLETITKNIKWLEKNLPTLRTWLMVNT

SEQ ID NO: 27286 - protein, 694 aa, Homo sapiens
  Payload ID: 5375
  Gene Symbol: ERAP2
  Gene Name: endoplasmic reticulum aminopeptidase 2
  ENSP ID: ENSP00000421175
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSP

SEQ ID NO: 27287 - protein, 532 aa, Homo sapiens
  Payload ID: 5375
  Gene Symbol: ERAP2
  Gene Name: endoplasmic reticulum aminopeptidase 2
  Uniprot ID: Q6P179
  ENSP ID: ENSP00000421849
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMVRIKRVTE

SEQ ID NO: 27288 - protein, 79 aa, Homo sapiens
  Payload ID: 5375
  Gene Symbol: ERAP2
  Gene Name: endoplasmic reticulum aminopeptidase 2
  ENSP ID: ENSP00000425415
  MOD_RES (1)..(1): Any amino acid
XGKVIKTQNLAALLHAIARRPKGQQLAWDFVRENWTHLLKKFDLGSYDIRMIISGTTAHFSSKDKLQEVCDFLFLTISK

SEQ ID NO: 27289 - protein, 350 aa, Homo sapiens
  Payload ID: 5375
  Gene Symbol: ERAP2
  Gene Name: endoplasmic reticulum aminopeptidase 2
  Uniprot ID: Q6P179
  ENSP ID: ENSP00000425758
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLGMFKFHIIVFIFAHKTCFDLFPLSLSM

SEQ ID NO: 27290 - protein, 29 aa, Homo sapiens
  Payload ID: 5375
  Gene Symbol: ERAP2
  Gene Name: endoplasmic reticulum aminopeptidase 2
  ENSP ID: ENSP00000426655
MLHRVDGLVSQGQDPSGRILAVTDFEPTQ

SEQ ID NO: 27291 - protein, 163 aa, Homo sapiens
  Payload ID: 5375
  Gene Symbol: ERAP2
  Gene Name: endoplasmic reticulum aminopeptidase 2
  ENSP ID: ENSP00000427573
  MOD_RES (1)..(1): Any amino acid
XQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFGACILNMLKDFLGEEKFQKGIIQYLKKFSYRNAKNDDLWSSLS

SEQ ID NO: 27292 - protein, 483 aa, Homo sapiens
  Payload ID: 5376
  Gene Symbol: ERLEC1
  Gene Name: endoplasmic reticulum lectin 1
  Uniprot ID: Q96DZ1
  ENSP ID: ENSP00000185150
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEEDLQSTKEERFPAIHKSIAIGSQPVLTVGTTHISKLTDDQLIKEFLSGSYCFRGGVGWWKYEFCYGKHVHQYHEDKDSGKTSVVVGTWNQEEHIEWAKKNTARAYHLQDDGTQTVRMVSHFYGNGDICDITDKPRQVTVKLKCKESDSPHAVTVYMLEPHSCQYILGVESPVICKILDTADENGLLSLPN

SEQ ID NO: 27293 - protein, 429 aa, Homo sapiens
  Payload ID: 5376
  Gene Symbol: ERLEC1
  Gene Name: endoplasmic reticulum lectin 1
  Uniprot ID: Q96DZ1
  ENSP ID: ENSP00000367485
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEGVGWWKYEFCYGKHVHQYHEDKDSGKTSVVVGTWNQEEHIEWAKKNTARAYHLQDDGTQTVRMVSHFYGNGDICDITDKPRQVTVKLKCKESDSPHAVTVYMLEPHSCQYILGVESPVICKILDTADENGLLSLPN

SEQ ID NO: 27294 - protein, 457 aa, Homo sapiens
  Payload ID: 5376
  Gene Symbol: ERLEC1
  Gene Name: endoplasmic reticulum lectin 1
  Uniprot ID: Q96DZ1
  ENSP ID: ENSP00000385629
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEEDLQSTKEERFPAIHKSIAIGSQPVLTVGTTHISKLTDDQLIKEFLSGSYCFRGGVGWWKYEFCYGKHVHQYHEDKDSGKTSVVVGTWNQEEHIEWAKKNTARAYHLQDDGTQTVRCKESDSPHAVTVYMLEPHSCQYILGVESPVICKILDTADENGLLSLPN

SEQ ID NO: 27295 - protein, 904 aa, Homo sapiens
  Payload ID: 5377
  Gene Symbol: ERMP1
  Gene Name: endoplasmic reticulum metallopeptidase 1
  Uniprot ID: Q7Z2K6
  ENSP ID: ENSP00000340427
MEWGSESAAVRRHRVGVERREGAAAAPPPEREARAQEPLVDGCSGGGRTRKRSPGGSGGASRGAGTGLSEVRAALGLALYLIALRTLVQLSLQQLVLRGAAGHRGEFDALQARDYLEHITSIGPRTTGSPENEILTVHYLLEQIKLIEVQSNSLHKISVDVQRPTGSFSIDFLGGFTSYYDNITNVVVKLEPRDGAQHAVLANCHFDSVANSPGASDDAVSCSVMLEVLRVLSTSSEALHHAVIFLFNGAEENVLQASHGFITQHPWASLIRAFINLEAAGVGGKELVFQTGPENPWLVQAYVSAAKHPFASVVAQEVFQSGIIPSDTDFRIYRDFGNIPGIDLAFIENGYIYHTKYDTADRILTDSIQRAGDNILAVLKHLATSDMLAAASKYRHGNMVFFDVLGLFVIAYPSRIGSIINYMVVMGVVLYLGKKFLQPKHKTGNYKKDFLCGLGITLISWFTSLVTVLIIAVFISLIGQSLSWYNHFYVSVCLYGTATVAKIILIHTLAKRFYYMNASAQYLGEVFFDISLFVHCCFLVTLTYQGLCSAFISAVWVAFPLLTKLCVHKDFKQHGAQGKFIAFYLLGMFIPYLYALYLIWAVFEMFTPILGRSGSEIPPDVVLASILAGCTMILSSYFINFIYLAKSTKKTMLTLTLVCAITFLLVCSGTFFPYSSNPANPKPKRVFLQHMTRTFHDLEGNAVKRDSGIWINGFDYTGISHITPHIPEINDSIRAHCEENAPLCGFPWYLPVHFLIRKNWYLPAPEVSPRNPPHFRLISKEQTPWDSIKLTFEATGPSHMSFYVRAHKGSTLSQWSLGNGTPVTSKGGDYFVFYSHGLQASAWQFWIEVQVSEEHPEGMVTVAIAAHYLSGEDKRSPQLDALKEKFPDWTFPSAWVCTYDLFVF

SEQ ID NO: 27296 - protein, 904 aa, Homo sapiens; identical to SEQ ID NO: 27295
  Payload ID: 5377
  Gene Symbol: ERMP1
  Gene Name: endoplasmic reticulum metallopeptidase 1
  Uniprot ID: Q7Z2K6
  ENSP ID: ENSP00000417160

SEQ ID NO: 27297 - protein, 841 aa, Homo sapiens
  Payload ID: 5377
  Gene Symbol: ERMP1
  Gene Name: endoplasmic reticulum metallopeptidase 1
  ENSP ID: ENSP00000417474
MEWGSESAAVRRHRVGVERREGAAAAPPPEREARAQEPLVDGCSGGGRTRKRSPGGSGGASRGAGTGLSEVRAALGLALYLIALRTLVQLSLQQLVLRGAAGHRGEFDALQARDYLEHITSIGPRTTGSPENEILTVHYLLEQIKLIEVQSNSLHKISVDVQRPTGSFSIDFLGGFTSYYDNITNVVVKLEPRDGAQHAVLANCHFDSVANSPGASDDAVSCSVMLEVLRVLSTSSEALHHAVIFLFNGAEENVLQASHGFITQHPWASLIRAFINLEAAGVGGKELVFQTGPENPWLVQAYVSAAKHPFASVVAQEVFQSGIIPSDTDFRIYRDFGNIPGIDLAFIENGYIYHTKYDTADRILTDSIQRAGDNILAVLKHLATSDMLAAASKYRHGNMVFFDVLGLFVIAYPSRIGSIINYMVVMGVVLYLGKKFLQPKHKTGNYKKDFLCGLGITLISWFTSLVTVLIIAVFISLIGQSLSWYNHFYVSVCLYGTATVAKIILIHTLAKRFYYMNASAQYLGEVFFDISLFVHCCFLVTLTYQGLCSAFISAVWVAFPLLTKLCVHKDFKQHGAQGKFIAFYLLGMFIPYLYALYLIWAVFEMFTPILGRSGSEIPPDVVLASILAGCTMILSSYFINFIYLAKSTKKTMLTLTLVCAITFLLVCSGTFFPYSSNPANPKPKRVFLQHMTRTFHDLEGNAVKRDSGIWINGFDYTGISHITPHIPEINDSIRAHCEENAPLCGFPWYLPVHFLIRKNWYLPAPEVSPRNPPHFRLISKEQTPWDSIKLTFEATACLPILQILDLPASTIMTKPYVLLCSSPQRVNTFSVVSWQWHPSHK

SEQ ID NO: 27298 - protein, 351 aa, Homo sapiens
  Payload ID: 5377
  Gene Symbol: ERMP1
  Gene Name: endoplasmic reticulum metallopeptidase 1
  ENSP ID: ENSP00000432986
MLEVLRVLSTSSEALHHAVIFLFNGAEENVLQASHGFITQHPWASLIRAFINLEAAGVGGKELVFQTGPENPWLVQAYVSAAKHPFASVVAQEVFQSGIIPSDTDFRIYRDFGNIPGIDLAFIENGYIYHTKYDTADRILTDSIQRAGDNILAVLKHLATSDMLAAASKYRHGNMVFFDVLGLFVIAYPSRIGSIINYMVVMGVVLYLGKKFLQPKHKTGNYKKDFLCGLGITLISWFTSLVTVLIIAVFISLIGQSLSWYNHFYVSVCLYGTATVAKIILIHTLAKRFYYMNASAQYLGEVFFDISLFVHCCFLVTLTYQGLCSAFISAVWVAFPLLTKLCVHKDFKQHD

SEQ ID NO: 27299 - protein, 468 aa, Homo sapiens
  Payload ID: 5378
  Gene Symbol: ERO1A
  Gene Name: endoplasmic reticulum oxidoreductase alpha
  Uniprot ID: Q96HE7
  ENSP ID: ENSP00000379042
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 27300 - protein, 75 aa, Homo sapiens
  Payload ID: 5378
  Gene Symbol: ERO1A
  Gene Name: endoplasmic reticulum oxidoreductase alpha
  ENSP ID: ENSP00000450655
MLLLEILHEIKSFPLHFDENSFFAGDKKEAHKLKEDFRLHFRNISRIMDCVGCFKCRLWGKLQTQGLGTALKILF

SEQ ID NO: 27301 - protein, 257 aa, Homo sapiens
  Payload ID: 5378
  Gene Symbol: ERO1A
  Gene Name: endoplasmic reticulum oxidoreductase alpha
  ENSP ID: ENSP00000451204
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGKLLICVSLLFLRSLCRKKSILQTYIWPTCKH

SEQ ID NO: 27302 - protein, 257 aa, Homo sapiens; identical to SEQ ID NO: 27301
  Payload ID: 5378
  Gene Symbol: ERO1A
  Gene Name: endoplasmic reticulum oxidoreductase alpha
  ENSP ID: ENSP00000452020

SEQ ID NO: 27303 - protein, 125 aa, Homo sapiens
  Payload ID: 5378
  Gene Symbol: ERO1A
  Gene Name: endoplasmic reticulum oxidoreductase alpha
  ENSP ID: ENSP00000452093
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKVCTYTY

SEQ ID NO: 27304 - protein, 169 aa, Homo sapiens
  Payload ID: 5378
  Gene Symbol: ERO1A
  Gene Name: endoplasmic reticulum oxidoreductase alpha
  ENSP ID: ENSP00000452269
MGRGWGFLFGLLGAVWLLSSGHGEEQPPETAAQRCFCQVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCF

SEQ ID NO: 27305 - protein, 257 aa, Homo sapiens; identical to SEQ ID NO: 27301
  Payload ID: 5378
  Gene Symbol: ERO1A
  Gene Name: endoplasmic reticulum oxidoreductase alpha
  ENSP ID: ENSP00000487101

SEQ ID NO: 27306 - protein, 173 aa, Homo sapiens
  Payload ID: 5379
  Gene Symbol: ERO1B
  Gene Name: endoplasmic reticulum oxidoreductase beta
  ENSP ID: ENSP00000264181
WGPNIKEFKHRFDPVETKGEGPRRLKNLYFLYLIELRALSKVAPYFERSIVDLYTGNAEEDADTKTLLLNIFQDTKSFPMHFDEKSMFAGDKKGAKSLKEEFRLHFKNISRIMDCVGCDKCRLWGKLQTQGLGTALKILFSEKEIQKLPENSPSKGFQLTRQEIVALLNAFGR

SEQ ID NO: 27307 - protein, 467 aa, Homo sapiens
  Payload ID: 5379
  Gene Symbol: ERO1B
  Gene Name: endoplasmic reticulum oxidoreductase beta
  Uniprot ID: Q86YB8
  ENSP ID: ENSP00000346635
MSQGVRRAGAGQGVAAAVQLLVTLSFLRSVVEAQVTGVLDDCLCDIDSIDNFNTYKIFPKIKKLQERDYFRYYKVNLKRPCPFWAEDGHCSIKDCHVEPCPESKIPVGIKAGHSNKYLKMANNTKELEDCEQANKLGAINSTLSNQSKEAFIDWARYDDSRDHFCELDDERSPAAQYVDLLLNPERYTGYKGTSAWRVWNSIYEENCFKPRSVYRPLNPLAPSRGEDDGESFYTWLEGLCLEKRVFYKLISGLHASINLHLCANYLLEETWGKPSWGPNIKEFKHRFDPVETKGEGPRRLKNLYFLYLIELRALSKVAPYFERSIVDLYTGNAEEDADTKTLLLNIFQDTKSFPMHFDEKSMFAGDKKGAKSLKEEFRLHFKNISRIMDCVGCDKCRLWGKLQTQGLGTALKILFSEKEIQKLPENSPSKGFQLTRQEIVALLNAFGRLSTSIRDLQNFKVLLQHSR

SEQ ID NO: 27308 - protein, 71 aa, Homo sapiens
  Payload ID: 5379
  Gene Symbol: ERO1B
  Gene Name: endoplasmic reticulum oxidoreductase beta
  ENSP ID: ENSP00000355548
MANNTKELEDCEQANKLGAINSTLSNQSKEAFIDWARYDDSRDHFCELDDERSPAAQYVDLLLNPERYTGY

SEQ ID NO: 27309 - protein, 273 aa, Homo sapiens
  Payload ID: 5380
  Gene Symbol: ERP27
  Gene Name: endoplasmic reticulum protein 27
  Uniprot ID: Q96DN0
  ENSP ID: ENSP00000266397
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 27310 - protein, 172 aa, Homo sapiens
  Payload ID: 5380
  Gene Symbol: ERP27
  Gene Name: endoplasmic reticulum protein 27
  ENSP ID: ENSP00000440573
MKETCQLEIQVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 27311 - protein, 261 aa, Homo sapiens
  Payload ID: 5381
  Gene Symbol: ERP29
  Gene Name: endoplasmic reticulum protein 29
  Uniprot ID: P30040
  ENSP ID: ENSP00000261735
MAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 27312 - protein, 53 aa, Homo sapiens
  Payload ID: 5381
  Gene Symbol: ERP29
  Gene Name: endoplasmic reticulum protein 29
  Uniprot ID: P30040
  ENSP ID: ENSP00000412083
MAAAVPRAAFLSPLLPLLLGFLLLSAPHGGSGLHTKGALPLDTVTFYKIMVTS

SEQ ID NO: 27313 - protein, 95 aa, Homo sapiens
  Payload ID: 5381
  Gene Symbol: ERP29
  Gene Name: endoplasmic reticulum protein 29
  ENSP ID: ENSP00000447472
  MOD_RES (1)..(1): Any amino acid
XPAPHFSPRCFPFSWASCSSPLRMAAAACTPRAPFPWIRSLSTRGPLGRGISPKSPWNTHLLSSIRPQVIPKSKFVLVKFDTQYPYGEKQDEFKR

SEQ ID NO: 27314 - protein, 160 aa, Homo sapiens
  Payload ID: 5381
  Gene Symbol: ERP29
  Gene Name: endoplasmic reticulum protein 29
  ENSP ID: ENSP00000449018
MELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 27315 - protein, 406 aa, Homo sapiens
  Payload ID: 5382
  Gene Symbol: ERP44
  Gene Name: endoplasmic reticulum protein 44
  Uniprot ID: Q9BS26
  ENSP ID: ENSP00000262455
MHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 27316 - protein, 977 aa, Homo sapiens
  Payload ID: 5383
  Gene Symbol: ERN1
  Gene Name: endoplasmic reticulum to nucleus signaling 1
  Uniprot ID: O75460
  ENSP ID: ENSP00000401445
MPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYKMSHFVSNGDGLVVTVDSESGDVLWIQNYASPVVAFYVWQREGLRKVMHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDVKFDPGLKSKNKLNYLRNYWLLIGHHETPLSASTKMLERFPNNLPKHRENVIPADSEKKSFEEVINLVDQTSENAPTTVSRDVEEKPAHAPARPEAPVDSMLKDMATIILSTFLLIGWVAFIITYPLSMHQQQQLQHQQFQKELEKIQLLQQQQQQLPFHPPGDTAQDGELLDTSGPYSESSGTSSPSTSPRASNHSLCSGSSASKAGSSPSLEQDDGDEETSVVIVGKISFCPKDVLGHGAEGTIVYRGMFDNRDVAVKRILPECFSFADREVQLLRESDEHPNVIRYFCTEKDRQFQYIAIELCAATLQEYVEQKDFAHLGLEPITLLQQTTSGLAHLHSLNIVHRDLKPHNILISMPNAHGKIKAMISDFGLCKKLAVGRHSFSRRSGVPGTEGWIAPEMLSEDCKENPTYTVDIFSAGCVFYYVISEGSHPFGKSLQRQANILLGACSLDCLHPEKHEDVIARELIEKMIAMDPQKRPSAKHVLKHPFFWSLEKQLQFFQDVSDRIEKESLDGPIVKQLERGGRAVVKMDWRENITVPLQTDLRKFRTYKGGSVRDLLRAMRNKKHHYRELPAEVRETLGSLPDDFVCYFTSRFPHLLAHTYRAMELCSHERLFQPYYFHEPPEPQPPVTPDAL

SEQ ID NO: 27317 - protein, 70 aa, Homo sapiens
  Payload ID: 5383
  Gene Symbol: ERN1
  Gene Name: endoplasmic reticulum to nucleus signaling 1
  Uniprot ID: O75460
  ENSP ID: ENSP00000475519
MPARRLLLLLTLLLPGLGVSDRGAWGGGQLATAGSGPGQRRGAGAGVRAGSATAAARCPVSPAVGGSGRA

SEQ ID NO: 27318 - protein, 926 aa, Homo sapiens
  Payload ID: 5384
  Gene Symbol: ERN2
  Gene Name: endoplasmic reticulum to nucleus signaling 2
  Uniprot ID: Q76MJ5
  ENSP ID: ENSP00000256797
MASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGTVLWTQDLGVPVMGVYTWHQDGLRQLPHLTLARDTLHFLALRWGHIRLPASGPRDTATLFSTLDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPADFAHISQDAQSLHSGASRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARRPCPGATGR

SEQ ID NO: 27319 - protein, 874 aa, Homo sapiens
  Payload ID: 5384
  Gene Symbol: ERN2
  Gene Name: endoplasmic reticulum to nucleus signaling 2
  ENSP ID: ENSP00000413812
MASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGTVLWTQDLGVPVMGVYTWHQDGLRQLPHLTLARDTLHFLALRWGHIRLPASGPRDTATLFSTLDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLEQQPQVVEKQQETPLAPADFAHISQDAQSLHSGASRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARRPCPGATGR

SEQ ID NO: 27320 - protein, 23 aa, Homo sapiens
  Payload ID: 5384
  Gene Symbol: ERN2
  Gene Name: endoplasmic reticulum to nucleus signaling 2
  ENSP ID: ENSP00000456866
ELLQLLPPDSPTRWLPGTWLEPC

SEQ ID NO: 27321 - protein, 129 aa, Homo sapiens
  Payload ID: 5384
  Gene Symbol: ERN2
  Gene Name: endoplasmic reticulum to nucleus signaling 2
  ENSP ID: ENSP00000457361
MASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMAGVQWYDHKAHCSLELLASSNPRTSVS

SEQ ID NO: 27322 - protein, 80 aa, Homo sapiens
  Payload ID: 5384
  Gene Symbol: ERN2
  Gene Name: endoplasmic reticulum to nucleus signaling 2
  ENSP ID: ENSP00000457796
MASAVRGSRPWPRLGLQLQFAALLLGTLSPQGCGWATRMLGLLLGAQPHPVCSRRDWSRFILSGQRTSCWCPPWMEVSTH

SEQ ID NO: 27323 - protein, 974 aa, Homo sapiens
  Payload ID: 5384
  Gene Symbol: ERN2
  Gene Name: endoplasmic reticulum to nucleus signaling 2
  ENSP ID: ENSP00000489461
MRRAGIGEDSRLGLQAQPGAEPSPGRAGTERSLGGTQGPGQPCSCPGAMASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGTVLWTQDLGVPVMGVYTWHQDGLRQLPHLTLARDTLHFLALRWGHIRLPASGPRDTATLFSTLDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPADFAHISQDAQSLHSGASRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARRPCPGATGR

SEQ ID NO: 27324 - protein, 159 aa, Homo sapiens
  Payload ID: 5385
  Gene Symbol: ERGIC1
  Gene Name: endoplasmic reticulum-golgi intermediate compartment 1
  Uniprot ID: Q969X5
  ENSP ID: ENSP00000325127
MERWAMRVNELYVDDPDKDSGGKIDVSLNISLPNLHCELVGLDIQDEMGRHEVGHIDNSMKIPLNNGAGCRFEGQFSINKVWKPCLSPFYLLPFPAVSPLPGNWLWRHSLDLTLTQPPASEGSCPAAWPFLLRIWMGVQAPWGFKPLMAGSGRSYSSLQ

SEQ ID NO: 27325 - protein, 290 aa, Homo sapiens
  Payload ID: 5385
  Gene Symbol: ERGIC1
  Gene Name: endoplasmic reticulum-golgi intermediate compartment 1
  Uniprot ID: Q969X5
  ENSP ID: ENSP00000377374
MPFDFRRFDIYRKVPKDLTQPTYTGAIISICCCLFILFLFLSELTGFITTEVVNELYVDDPDKDSGGKIDVSLNISLPNLHCELVGLDIQDEMGRHEVGHIDNSMKIPLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITTICAIIGGTFTVAGILDSCIFTASEAWKKIQLGKMH

SEQ ID NO: 27326 - protein, 138 aa, Homo sapiens
  Payload ID: 5385
  Gene Symbol: ERGIC1
  Gene Name: endoplasmic reticulum-golgi intermediate compartment 1
  ENSP ID: ENSP00000427713
MPFDFRRFDIYRKVPKDLTQPTYTGAIISICCCLFILFLFLSELTGFITTEVVNELYVDDPDKDSGGKIDVSLNISLPNLHCELVGLDIQDEMGRHEVGHIDNSMKIPLNNGAGCRFEGQFSINKEVDQQPDVRVCVF

SEQ ID NO: 27327 - protein, 55 aa, Homo sapiens
  Payload ID: 5385
  Gene Symbol: ERGIC1
  Gene Name: endoplasmic reticulum-golgi intermediate compartment 1
  ENSP ID: ENSP00000428064
MPFDFRRFDIYRKVPKDLTQPTYTGAIISICCCLFILFLFLSELTGFITTEVGWA

SEQ ID NO: 27328 - protein, 54 aa, Homo sapiens
  Payload ID: 5385
  Gene Symbol: ERGIC1
  Gene Name: endoplasmic reticulum-golgi intermediate compartment 1
  ENSP ID: ENSP00000428116
  MOD_RES (1)..(1): Any amino acid
XVNELYVDDPDKDSGGKIDVSLNISLPNLHCEFFGPQTMSSWRSPARPAPAMDE

SEQ ID NO: 27329 - protein, 105 aa, Homo sapiens
  Payload ID: 5385
  Gene Symbol: ERGIC1
  Gene Name: endoplasmic reticulum-golgi intermediate compartment 1
  ENSP ID: ENSP00000429501
MERWAMRVNELYVDDPDKDSGGKIDVSLNISLPNLHCELVGLDIQDEMGRHEVGHIDNSMKIPLNNGAGCRFEGQFSINKVPGNFHVSTHSATAQPQNPDMTHVI

SEQ ID NO: 27330 - protein, 117 aa, Homo sapiens
  Payload ID: 5386
  Gene Symbol: ENSA
  Gene Name: endosulfine alpha
  Uniprot ID: O43768
  ENSP ID: ENSP00000271690
MSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAG

SEQ ID NO: 27331 - protein, 137 aa, Homo sapiens
  Payload ID: 5386
  Gene Symbol: ENSA
  Gene Name: endosulfine alpha
  Uniprot ID: O43768
  ENSP ID: ENSP00000341743
MSQKQEEENPAEETGEEKQDTQEKEGILPERAEEAKLKAKYPSLGQKPGGSDFLMKRLQKGDYKSLHWSVLLCADEMQKYFDSGDYNMAKAKMKNKQLPSAGPDKNLVTGDHIPTPQDLPQRKSSLVTSKLAGGQVE

SEQ ID NO: 27332 - protein, 140 aa, Homo sapiens
  Payload ID: 5386
  Gene Symbol: ENSA
  Gene Name: endosulfine alpha
  ENSP ID: ENSP00000348921
MSQKQEEENPAEETGEEKQDTQEKEGILPERAEEAKLKAKYPSLGQKPGGSDFLMKRLQKGVWGIVSYPLSLELKEVLRMKSVEQKYFDSGDYNMAKAKMKNKQLPSAGPDKNLVTGDHIPTPQDLPQRKSSLVTSKLAG

SEQ ID NO: 27333 - protein, 117 aa, Homo sapiens
  Payload ID: 5386
  Gene Symbol: ENSA
  Gene Name: endosulfine alpha
  Uniprot ID: O43768
  ENSP ID: ENSP00000354835
MAGGLGCDVCYWFVEDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQVE

SEQ ID NO: 27334 - protein, 105 aa, Homo sapiens
  Payload ID: 5386
  Gene Symbol: ENSA
  Gene Name: endosulfine alpha
  Uniprot ID: O43768
  ENSP ID: ENSP00000355220
MSQKQEEENPAEETGEEKQDTQEKEGILPERAEEAKLKAKYPSLGQKPGGSDFLMKRLQKGVWGIVSYPLSLELKEVLRMKSVEVLLDPFLEVLLLNRSRGEFEI

SEQ ID NO: 27335 - protein, 133 aa, Homo sapiens
  Payload ID: 5386
  Gene Symbol: ENSA
  Gene Name: endosulfine alpha
  Uniprot ID: O43768
  ENSP ID: ENSP00000355239
MAGGLGCDVCYWFVEDTQEKEGILPERAEEAKLKAKYPSLGQKPGGSDFLMKRLQKGDYKSLHWSVLLCADEMQKYFDSGDYNMAKAKMKNKQLPSAGPDKNLVTGDHIPTPQDLPQRKSSLVTSKLAGGQVE

SEQ ID NO: 27336 - protein, 121 aa, Homo sapiens
  Payload ID: 5386
  Gene Symbol: ENSA
  Gene Name: endosulfine alpha
  Uniprot ID: O43768
  ENSP ID: ENSP00000358010
MSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAGGQVE

SEQ ID NO: 27337 - protein, 187 aa, Homo sapiens
  Payload ID: 5386
  Gene Symbol: ENSA
  Gene Name: endosulfine alpha
  ENSP ID: ENSP00000358012
MSQKQEEENPAEETGEEKQDTQEKEGILPERAEEAKLKAKYPSLGQKPGGSDFLMKRLQKGDYKSLHWSVLLCADEMQKYFDSGDYNMAKAKMKNKQLPSAGPDKNLVTGDHIPTPQDLPQRKSSLVTSKLAGQSFALVAQAGVQWHDLCLLQPLPPGFKRFSCLSLLSSWDYRHATPRPANFVIFL

SEQ ID NO: 27338 - protein, 105 aa, Homo sapiens; identical to SEQ ID NO: 27334
  Payload ID: 5386
  Gene Symbol: ENSA
  Gene Name: endosulfine alpha
  Uniprot ID: O43768
  ENSP ID: ENSP00000421458

SEQ ID NO: 27339 - protein, 113 aa, Homo sapiens
  Payload ID: 5386
  Gene Symbol: ENSA
  Gene Name: endosulfine alpha
  Uniprot ID: O43768
  ENSP ID: ENSP00000422343
MAGGLGCDVCYWFVEDTQEKEGILPERAEEAKLKAKYPSLGQKPGGSDFLMKRLQKGQKYFDSGDYNMAKAKMKNKQLPSAGPDKNLVTGDHIPTPQDLPQRKSSLVTSKLAG

SEQ ID NO: 27340 - protein, 133 aa, Homo sapiens
  Payload ID: 5386
  Gene Symbol: ENSA
  Gene Name: endosulfine alpha
  Uniprot ID: O43768
  ENSP ID: ENSP00000424242
MSQKQEEENPAEETGEEKQDTQEKEGILPERAEEAKLKAKYPSLGQKPGGSDFLMKRLQKGDYKSLHWSVLLCADEMQKYFDSGDYNMAKAKMKNKQLPSAGPDKNLVTGDHIPTPQDLPQRKSSLVTSKLAG

SEQ ID NO: 27341 - protein, 105 aa, Homo sapiens; identical to SEQ ID NO: 27334
  Payload ID: 5386
  Gene Symbol: ENSA
  Gene Name: endosulfine alpha
  Uniprot ID: O43768
  ENSP ID: ENSP00000426110

SEQ ID NO: 27342 - protein, 390 aa, Homo sapiens
  Payload ID: 5387
  Gene Symbol: ESAM
  Gene Name: endothelial cell adhesion molecule
  Uniprot ID: Q96AP7
  ENSP ID: ENSP00000278927
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 27343 - protein, 245 aa, Homo sapiens
  Payload ID: 5387
  Gene Symbol: ESAM
  Gene Name: endothelial cell adhesion molecule
  ENSP ID: ENSP00000389235
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGQ

SEQ ID NO: 27344 - protein, 141 aa, Homo sapiens
  Payload ID: 5387
  Gene Symbol: ESAM
  Gene Name: endothelial cell adhesion molecule
  Uniprot ID: Q96AP7
  ENSP ID: ENSP00000406689
MISLPGPLVTNLLRFLFLGLSALDVIRGSLSLTNLSSSMAGVYVCKAHNEVGTAQCNVTLEVSTGPGAAVVAGAVVGTLVGLGLLAGLVLLYHRRGKALEEPANDIKVRSPLGLSFSAPKMEWLWKWRDAHFYRDSYLSKW

SEQ ID NO: 27345 - protein, 148 aa, Homo sapiens
  Payload ID: 5387
  Gene Symbol: ESAM
  Gene Name: endothelial cell adhesion molecule
  ENSP ID: ENSP00000415893
MISLPGPLVTNLLRFLFLGLSALVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRG

SEQ ID NO: 27346 - protein, 205 aa, Homo sapiens
  Payload ID: 5388
  Gene Symbol: ECSCR
  Gene Name: endothelial cell surface expressed chemotaxis and apoptosis regulator
  Uniprot ID: Q19T08
  ENSP ID: ENSP00000479243
MGTAGAMQLCWVILGFLLFRGHNSQPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAAFGVISFIVILVVVVIILVGVVSLRFKCRKSKESEDPQKPGSSGLSESCSTANGEKDSITLISMKNINMNNGKQSLSAEKVL

SEQ ID NO: 27347 - protein, 205 aa, Homo sapiens; identical to SEQ ID NO: 27346
  Payload ID: 5389
  Gene Symbol:
  Gene Name: endothelial cell surface expressed chemotaxis and apoptosis regulator [Source:EntrezGene Acc:641700]
  Uniprot ID: Q19T08
  ENSP ID: ENSP00000421364

SEQ ID NO: 27348 - protein, 134 aa, Homo sapiens
  Payload ID: 5390
  Gene Symbol: ESM1
  Gene Name: endothelial cell-specific molecule 1
  Uniprot ID: Q9NQ30
  ENSP ID: ENSP00000370810
MKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKEHDMASGDGNIVREEVVKENAAGSPVMRKWLNPR

SEQ ID NO: 27349 - protein, 184 aa, Homo sapiens
  Payload ID: 5390
  Gene Symbol: ESM1
  Gene Name: endothelial cell-specific molecule 1
  Uniprot ID: Q9NQ30
  ENSP ID: ENSP00000370812
MKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKDCPYGTFGMDCRETCNCQSGICDRGTGKCLKFPFFQYSVTKSSNRFVSLTEHDMASGDGNIVREEVVKENAAGSPVMRKWLNPR

SEQ ID NO: 27350 - protein, 89 aa, Homo sapiens
  Payload ID: 5390
  Gene Symbol: ESM1
  Gene Name: endothelial cell-specific molecule 1
  ENSP ID: ENSP00000471642
MKSVLLLTTLLVPAHLVAAWSNNYAVDCPQHCDSSECKSSPRCKRTVLDDCGCCRVCAAGRGETCYRTVSGMDGMKCGPGLRCQPSNGE

SEQ ID NO: 27351 - protein, 148 aa, Homo sapiens
  Payload ID: 5391
  Gene Symbol: EDF1
  Gene Name: endothelial differentiation-related factor 1
  Uniprot ID: O60869
  ENSP ID: ENSP00000224073
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 27352 - protein, 139 aa, Homo sapiens
  Payload ID: 5391
  Gene Symbol: EDF1
  Gene Name: endothelial differentiation-related factor 1
  Uniprot ID: O60869
  ENSP ID: ENSP00000360711
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGECPSTLRRVR

SEQ ID NO: 27353 - protein, 141 aa, Homo sapiens
  Payload ID: 5391
  Gene Symbol: EDF1
  Gene Name: endothelial differentiation-related factor 1
  Uniprot ID: O60869
  ENSP ID: ENSP00000360712
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIDVGTRSARVLRAQ

SEQ ID NO: 27354 - protein, 870 aa, Homo sapiens
  Payload ID: 5392
  Gene Symbol: EPAS1
  Gene Name: endothelial PAS domain protein 1
  Uniprot ID: Q99814
  ENSP ID: ENSP00000263734
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFTKLKEEPEELAQLAPTPGDAIISLDFGNQNFEESSAYGKAILPPSQPWATELRSHSTQSEAGSLPAFTVPQAAAPGSTTPSATSSSSSCSTPNSPEDYYTSLDNDLKIEVIEKLFAMDTEAKDQCSTQTDFNELDLETLAPYIPMDGEDFQLSPICPEERLLAENPQSTPQHCFSAMTNIFQPLAPVAPHSPFLLDKFQQQLESKKTEPEHRPMSSIFFDAGSKASLPPCCGQASTPLSSMGGRSNTQWPPDPPLHFGPTKWAVGDQRTEFLGAAPLGPPVSPPHVSTFKTRSAKGFGARGPDVLSPAMVALSNKLKLKRQLEYEEQAFQDLSGGDPPGGSTSHLMWKRMKNLRGGSCPLMPDKPLSANVPNDKFTQNPMRGLGHPLRHLPLPQPPSAISPGENSKSRFPPQCYATQYQDYSLSSAHKVSGMASRLLGPSFESYLLPELTRYDCEVNVPVLGSSTLLQGGDLLRALDQAT

SEQ ID NO: 27355 - protein, 259 aa, Homo sapiens
  Payload ID: 5392
  Gene Symbol: EPAS1
  Gene Name: endothelial PAS domain protein 1
  ENSP ID: ENSP00000406137
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDD

SEQ ID NO: 27356 - protein, 212 aa, Homo sapiens
  Payload ID: 5393
  Gene Symbol: EDN1
  Gene Name: endothelin 1
  Uniprot ID: P05305
  ENSP ID: ENSP00000368683
MDYLLMIFSLLFVACQGAPETAVLGAELSAVGENGGEKPTPSPPWRLRRSKRCSCSSLMDKECVYFCHLDIIWVNTPEHVVPYGLGSPRSKRALENLLPTKATDRENRCQCASQKDKKCWNFCQAGKELRAEDIMEKDWNNHKKGKDCSKLGKKCIYQQLVRGRKIRRSSEEHLRQTRSETMRNSVKSSFHDPKLKGKPSRERYVTHNRAHW

SEQ ID NO: 27357 - protein, 178 aa, Homo sapiens
  Payload ID: 5394
  Gene Symbol: EDN2
  Gene Name: endothelin 2
  Uniprot ID: P20800
  ENSP ID: ENSP00000361668
MVSVPTTWCSVALALLVALHEGKGQAAATLEQPASSSHAQGTHLRLRRCSCSSWLDKECVYFCHLDIIWVNTPEQTAPYGLGNPPRRRRRSLPRRCQCSSARDPACATFCLRRPWTEAGAVPSRKSPADVFQTGKTGATTGELLQRLRDISTVKSLFAKRQQEAMREPRSTHSRWRKR

SEQ ID NO: 27358 - protein, 219 aa, Homo sapiens
  Payload ID: 5395
  Gene Symbol: EDN3
  Gene Name: endothelin 3
  Uniprot ID: P14138
  ENSP ID: ENSP00000311854
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVRGANRGLCQRRLKSRTNKASRL

SEQ ID NO: 27359 - protein, 238 aa, Homo sapiens
  Payload ID: 5395
  Gene Symbol: EDN3
  Gene Name: endothelin 3
  Uniprot ID: P14138
  ENSP ID: ENSP00000337128
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVEVKDQQSKQALDLHHPKLMPGSGLALAPSTCPRCLFQEGAP

SEQ ID NO: 27360 - protein, 192 aa, Homo sapiens
  Payload ID: 5395
  Gene Symbol: EDN3
  Gene Name: endothelin 3
  ENSP ID: ENSP00000360064
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSRLKSRTNKASRL

SEQ ID NO: 27361 - protein, 238 aa, Homo sapiens; identical to SEQ ID NO: 27359
  Payload ID: 5395
  Gene Symbol: EDN3
  Gene Name: endothelin 3
  Uniprot ID: P14138
  ENSP ID: ENSP00000360067

SEQ ID NO: 27362 - protein, 224 aa, Homo sapiens
  Payload ID: 5395
  Gene Symbol: EDN3
  Gene Name: endothelin 3
  Uniprot ID: P14138
  ENSP ID: ENSP00000379015
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSRQVEVKDQQSKQALDLHHPKLMPGSGLALAPSTCPRCLFQEGAP

SEQ ID NO: 27363 - protein, 767 aa, Homo sapiens
  Payload ID: 5396
  Gene Symbol: ECE1
  Gene Name: endothelin converting enzyme 1
  Uniprot ID: P42892
  ENSP ID: ENSP00000264205
MEALRESVLHLALQMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 27364 - protein, 758 aa, Homo sapiens
  Payload ID: 5396
  Gene Symbol: ECE1
  Gene Name: endothelin converting enzyme 1
  Uniprot ID: P42892
  ENSP ID: ENSP00000349581
MPLQGLGLQRNPFLQGKRGPGLTSSPPLLPPSLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 27365 - protein, 770 aa, Homo sapiens
  Payload ID: 5396
  Gene Symbol: ECE1
  Gene Name: endothelin converting enzyme 1
  Uniprot ID: P42892
  ENSP ID: ENSP00000364028
MRGVWPPPVSALLSALGMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 27366 - protein, 738 aa, Homo sapiens
  Payload ID: 5396
  Gene Symbol: ECE1
  Gene Name: endothelin converting enzyme 1
  ENSP ID: ENSP00000388439
MRGVWPPPVSALLSALGMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRVWCSVRTPESSHEGLITDPHSPSRFRVIGSLSNSKEFSEHFRCPPGSPMNPPHKCEVW

SEQ ID NO: 27367 - protein, 754 aa, Homo sapiens
  Payload ID: 5396
  Gene Symbol: ECE1
  Gene Name: endothelin converting enzyme 1
  Uniprot ID: P42892
  ENSP ID: ENSP00000405088
MMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 27368 - protein, 77 aa, Homo sapiens
  Payload ID: 5396
  Gene Symbol: ECE1
  Gene Name: endothelin converting enzyme 1
  ENSP ID: ENSP00000431856
MDPTVDPCHDFFSYACGGWIKANPVPDGHSRWGTFSNLWEHNQAIIKHLLENSTASVSEAERKAQVYYRACMNETRI

SEQ ID NO: 27369 - protein, 103 aa, Homo sapiens
  Payload ID: 5396
  Gene Symbol: ECE1
  Gene Name: endothelin converting enzyme 1
  ENSP ID: ENSP00000432860
MSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVD

SEQ ID NO: 27370 - protein, 134 aa, Homo sapiens
  Payload ID: 5396
  Gene Symbol: ECE1
  Gene Name: endothelin converting enzyme 1
  ENSP ID: ENSP00000436633
MEQMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGT

SEQ ID NO: 27371 - protein, 255 aa, Homo sapiens
  Payload ID: 5397
  Gene Symbol: ECE2
  Gene Name: endothelin converting enzyme 2
  Uniprot ID: O60344
  ENSP ID: ENSP00000314295
MASPGAGRAPPELPERNCGYREVEYWDQRYQGAADSAPYDWFGDFSSFRALLEPELRPEDRILVLGCGNSALSYELFLGGFPNVTSVDYSSVVVAAMQARHAHVPQLRWETMDVRKLDFPSASFDVVLEKGTLDALLAGERDPWTVSSEGVHTVDQVLSEVSRVLVPGGRFISMTSAAPHFRTRHYAQAYYGWSLRHATYGSGFHFHLYLMHKGGKLSVAQLALGAQILSPPRPPTSPCFLQDSDHEDFLSAIQL

SEQ ID NO: 27372 - protein, 811 aa, Homo sapiens
  Payload ID: 5397
  Gene Symbol: ECE2
  Gene Name: endothelin converting enzyme 2
  Uniprot ID: O60344
  ENSP ID: ENSP00000350066
MNVALQELGAGSNMVEYKRATLRDEDAPETPVEGGASPDAMEVGKGASPFSPGPSPGMTPGTPRSSGLFWRVTCPHLRSISGLCSRTMVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 27373 - protein, 736 aa, Homo sapiens
  Payload ID: 5397
  Gene Symbol: ECE2
  Gene Name: endothelin converting enzyme 2
  Uniprot ID: O60344
  ENSP ID: ENSP00000352052
MNVALQELGAGSNVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 27374 - protein, 883 aa, Homo sapiens
  Payload ID: 5397
  Gene Symbol: ECE2
  Gene Name: endothelin converting enzyme 2
  Uniprot ID: O60344
  ENSP ID: ENSP00000384223
MASPGAGRAPPELPERNCGYREVEYWDQRYQGAADSAPYDWFGDFSSFRALLEPELRPEDRILVLGCGNSALSYELFLGGFPNVTSVDYSSVVVAAMQARHAHVPQLRWETMDVRKLDFPSASFDVVLEKGTLDALLAGERDPWTVSSEGVHTVDQVLSEVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 27375 - protein, 765 aa, Homo sapiens
  Payload ID: 5397
  Gene Symbol: ECE2
  Gene Name: endothelin converting enzyme 2
  Uniprot ID: O60344
  ENSP ID: ENSP00000385846
MNVALQELGAGSNMVEYKRATLRDEDAPETPVEGGASPDAMEVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVWCSVRTPESSHEGLVTDPHSPARFRVLGTLSNSRDFLRHFGCPVGSPMNPGQLCEVW

SEQ ID NO: 27376 - protein, 67 aa, Homo sapiens
  Payload ID: 5397
  Gene Symbol: ECE2
  Gene Name: endothelin converting enzyme 2
  ENSP ID: ENSP00000392467
MNVALQELGAGSNVGFQKGTRQLLGSRTQLELVLAGASLLLAALLLGCLVALGVQYHREFASSRQTD

SEQ ID NO: 27377 - protein, 716 aa, Homo sapiens
  Payload ID: 5397
  Gene Symbol: ECE2
  Gene Name: endothelin converting enzyme 2
  ENSP ID: ENSP00000398444
SPGMTPGTPRSSGLFWRVTCPHLRSISGLCSRTMVGFQKGTRQLLGSRTQLELVLAGASLLLAALLLGCLVALGVQYHRDPSHSTCLTEACIRVAGKILESLDRGVSPCEDFYQFSCGGWIRRNPLPDGRSRWNTFNSLWDQNQAILKHLLENTTFNSSSEAEQKTQRFYLSCLQVERIEELGAQPLRDLIEKIGGWNITGPWDQDNFMEVLKAVAGTYRATPFFTVYISADSKSSNSNVIQVDQSGLFLPSRDYYLNRTANEKVLTAYLDYMEELGMLLGGRPTSTREQMQQVLELEIQLANITVPQDQRRDEEKIYHKMSISELQALAPSMDWLEFLSFLLSPLELSDSEPVVVYGMDYLQQVSELINRTEPSILNNYLIWNLVQKTTSSLDRRFESAQEKLLETLYGTKKSCVPRWQTCISNTDDALGFALGSLFVKATFDRQSKEIAEGMISEIRTAFEEALGQLVWMDEKTRQAAKEKADAIYDMIGFPDFILEPKELDDVYDGYEISEDSFFQNMLNLYNFSAKVMADQLRKPPSRDQWSMTPQTVNAYYLPTKNEIVFPAGILQAPFYARNHPKALNFGGIGVVMGHELTHAFDDQGREYDKEGNLRPWWQNESLAAFRNHTACMEEQYNQYQVNGERLNGRQTLGENIADNGGLKAAYNAYKAWLRKHGEEQQLPAVGLTNHQLFFVGFAQVSPSRKAWGLPLCPAPS

SEQ ID NO: 27378 - protein, 775 aa, Homo sapiens
  Payload ID: 5398
  Gene Symbol: ECEL1
  Gene Name: endothelin converting enzyme-like 1
  Uniprot ID: O95672
  ENSP ID: ENSP00000302051
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEHDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKSTWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 27379 - protein, 773 aa, Homo sapiens
  Payload ID: 5398
  Gene Symbol: ECEL1
  Gene Name: endothelin converting enzyme-like 1
  Uniprot ID: O95672
  ENSP ID: ENSP00000386333
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEHDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 27380 - protein, 168 aa, Homo sapiens
  Payload ID: 5398
  Gene Symbol: ECEL1
  Gene Name: endothelin converting enzyme-like 1
  ENSP ID: ENSP00000412683
GILQPTLYDPDFPQSLNYGGIGTIIGHELTHGYDDWGGQYDRSGNLLHWWTEASYSRFLRKAECIVRLYDNFTVYNQRAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 27381 - protein, 427 aa, Homo sapiens
  Payload ID: 5399
  Gene Symbol: EDNRA
  Gene Name: endothelin receptor type A
  Uniprot ID: P25101
  ENSP ID: ENSP00000315011
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKLLAGRWPFDHNDFGVFLCKLFPFLQKSSVGITVLNLCALSVDRYRAVASWSRVQGIGIPLVTAIEIVSIWILSFILAIPEAIGFVMVPFEYRGEQHKTCMLNATSKFMEFYQDVKDWWLFGFYFCMPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 27382 - protein, 318 aa, Homo sapiens
  Payload ID: 5399
  Gene Symbol: EDNRA
  Gene Name: endothelin receptor type A
  Uniprot ID: P25101
  ENSP ID: ENSP00000351359
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKFYQDVKDWWLFGFYFCMPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 27383 - protein, 318 aa, Homo sapiens; identical to SEQ ID NO: 27382
  Payload ID: 5399
  Gene Symbol: EDNRA
  Gene Name: endothelin receptor type A
  Uniprot ID: P25101
  ENSP ID: ENSP00000425281

SEQ ID NO: 27384 - protein, 202 aa, Homo sapiens
  Payload ID: 5399
  Gene Symbol: EDNRA
  Gene Name: endothelin receptor type A
  Uniprot ID: P25101
  ENSP ID: ENSP00000425354
MVPFEYRGEQHKTCMLNATSKFMEFYQDVKDWWLFGFYFCMPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 27385 - protein, 187 aa, Homo sapiens
  Payload ID: 5399
  Gene Symbol: EDNRA
  Gene Name: endothelin receptor type A
  Uniprot ID: P25101
  ENSP ID: ENSP00000427259
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKLLAGRWPFDHNDFGVFLCKLFPFLQKSSVGITVLNLCALSVDSSTKM

SEQ ID NO: 27386 - protein, 442 aa, Homo sapiens
  Payload ID: 5400
  Gene Symbol: EDNRB
  Gene Name: endothelin receptor type B
  Uniprot ID: P24530
  ENSP ID: ENSP00000335311
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 27387 - protein, 532 aa, Homo sapiens
  Payload ID: 5400
  Gene Symbol: EDNRB
  Gene Name: endothelin receptor type B
  Uniprot ID: P24530
  ENSP ID: ENSP00000366416
MNKSTCLMAAETPSKRWRLHCLAFSQRFVRAGPACSSREACSSPRAGWNPAGFRLPGRWSPFVALHLVCQIREALKLRSGHRTPSGAGSSMQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 27388 - protein, 436 aa, Homo sapiens
  Payload ID: 5400
  Gene Symbol: EDNRB
  Gene Name: endothelin receptor type B
  Uniprot ID: P24530
  ENSP ID: ENSP00000486202
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKAGPHVGNKLVMLFSVNIECDGTVNQNPTMWPERKSNNN

SEQ ID NO: 27389 - protein, 78 aa, Homo sapiens
  Payload ID: 5400
  Gene Symbol: EDNRB
  Gene Name: endothelin receptor type B
  ENSP ID: ENSP00000487082
MQPPPSLCGRALVALVLACGLSRIWGEERGFPPDRATPLLQTAEIMTPPTKTLWPKGSNASLARSLAPAEVPKGDRTA

SEQ ID NO: 27390 - protein, 76 aa, Homo sapiens
  Payload ID: 5401
  Gene Symbol: ENHO
  Gene Name: energy homeostasis associated
  Uniprot ID: Q6UWT2
  ENSP ID: ENSP00000382675
MGAAISQGALIAIVCNGLVGFLLLLLWVILCWACHSRSADVDSLSESSPNSSPGPCPEKAPPPQKPSHEGSYLLQP

SEQ ID NO: 27391 - protein, 392 aa, Homo sapiens
  Payload ID: 5402
  Gene Symbol: EN1
  Gene Name: engrailed homeobox 1
  Uniprot ID: Q05925
  ENSP ID: ENSP00000295206
MEEQQPEPKSQRDSALGAAAAATPGGLSLSLSPGASGSSGSGSDGDSVPVSPQPAPPSPPAAPCLPPLAHHPHLPPHPPPPPPQHLAAPAHQPQPAAQLHRTTNFFIDNILRPDFGCKKEQPPPQLLVAAAARGGAGGGGRVERDRGQTAAGRDPVHPLGTRAPGAASLLCAPDANCGPPDGSQPAAAGAGASKAGNPAAAAAAAAAAVAAAAAAAAAKPSDTGGGGSGGGAGSPGAQGTKYPEHGNPAILLMGSANGGPVVKTDSQQPLVWPAWVYCTRYSDRPSSGPRTRKLKKKKNEKEDKRPRTAFTAEQLQRLKAEFQANRYITEQRRQTLAQELSLNESQIKIWFQNKRAKIKKATGIKNGLALHLMAQGLYNHSTTTVQDKDESE

SEQ ID NO: 27392 - protein, 333 aa, Homo sapiens
  Payload ID: 5403
  Gene Symbol: EN2
  Gene Name: engrailed homeobox 2
  Uniprot ID: P19622
  ENSP ID: ENSP00000297375
MEENDPKPGEAAAAVEGQRQPESSPGGGSGGGGGSSPGEADTGRRRALMLPAVLQAPGNHQHPHRITNFFIDNILRPEFGRRKDAGTCCAGAGGGRGGGAGGEGGASGAEGGGGAGGSEQLLGSGSREPRQNPPCAPGAGGPLPAAGSDSPGDGEGGSKTLSLHGGAKKGGDPGGPLDGSLKARGLGGGDLSVSSDSDSSQAGANLGAQPMLWPAWVYCTRYSDRPSSGPRSRKPKKKNPNKEDKRPRTAFTAEQLQRLKAEFQTNRYLTEQRRQSLAQELSLNESQIKIWFQNKRAKIKKATGNKNTLAVHLMAQGLYNHSTTAKEGKSDSE

SEQ ID NO: 27393 - protein, 727 aa, Homo sapiens
  Payload ID: 5404
  Gene Symbol: ELMO1
  Gene Name: engulfment and cell motility 1
  Uniprot ID: Q92556
  ENSP ID: ENSP00000312185
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKPCFGDMLSFTLTAFVELMDHGIVSWDTFSVAFIKKIASFVNKSAIDISILQRSLAILESMVLNSHDLYQKVAQEITIGQLIPHLQGSDQEIQTYTIAVINALFLKAPDERRQEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRIVLENSSREDKHECPFGRSSIELTKMLCEILKVGELPSETCNDFHPMFFTHDRSFEEFFCICIQLLNKTWKEMRATSEDFNKVMQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 27394 - protein, 247 aa, Homo sapiens
  Payload ID: 5404
  Gene Symbol: ELMO1
  Gene Name: engulfment and cell motility 1
  Uniprot ID: Q92556
  ENSP ID: ENSP00000379355
MQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 27395 - protein, 247 aa, Homo sapiens; identical to SEQ ID NO: 27394
  Payload ID: 5404
  Gene Symbol: ELMO1
  Gene Name: engulfment and cell motility 1
  Uniprot ID: Q92556
  ENSP ID: ENSP00000379360

SEQ ID NO: 27396 - protein, 81 aa, Homo sapiens
  Payload ID: 5404
  Gene Symbol: ELMO1
  Gene Name: engulfment and cell motility 1
  ENSP ID: ENSP00000391734
MPPPADIVKVAIEWPGAYPKLMEIDQKKPLSAIIKEVCDGWSLANHEYFALQHADSSNFYITEKNRNEIKNGTILRLTTSP

SEQ ID NO: 27397 - protein, 727 aa, Homo sapiens; identical to SEQ ID NO: 27393
  Payload ID: 5404
  Gene Symbol: ELMO1
  Gene Name: engulfment and cell motility 1
  Uniprot ID: Q92556
  ENSP ID: ENSP00000394458

SEQ ID NO: 27398 - protein, 124 aa, Homo sapiens
  Payload ID: 5404
  Gene Symbol: ELMO1
  Gene Name: engulfment and cell motility 1
  ENSP ID: ENSP00000395933
QEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFIVSKLSPVCALPPASPGLTSAT

SEQ ID NO: 27399 - protein, 182 aa, Homo sapiens
  Payload ID: 5404
  Gene Symbol: ELMO1
  Gene Name: engulfment and cell motility 1
  ENSP ID: ENSP00000396465
ANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRIVLENSSREDKHECPFGRSSIELTKMLCEILKVGELHHLSPEKFTLP

SEQ ID NO: 27400 - protein, 59 aa, Homo sapiens
  Payload ID: 5404
  Gene Symbol: ELMO1
  Gene Name: engulfment and cell motility 1
  ENSP ID: ENSP00000397857
MPPPADIVKVAIEWPGAYPKLMEIDQKKPLSAIIKEVCDGWSLANHEYFALQHADSSNF

SEQ ID NO: 27401 - protein, 167 aa, Homo sapiens
  Payload ID: 5404
  Gene Symbol: ELMO1
  Gene Name: engulfment and cell motility 1
  ENSP ID: ENSP00000406610
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTDFGDMLSFTLTAFVELMDHGIVSWDTFSVA

SEQ ID NO: 27402 - protein, 727 aa, Homo sapiens; identical to SEQ ID NO: 27393
  Payload ID: 5404
  Gene Symbol: ELMO1
  Gene Name: engulfment and cell motility 1
  Uniprot ID: Q92556
  ENSP ID: ENSP00000406952

SEQ ID NO: 27403 - protein, 193 aa, Homo sapiens
  Payload ID: 5404
  Gene Symbol: ELMO1
  Gene Name: engulfment and cell motility 1
  ENSP ID: ENSP00000413108
  MOD_RES (1)..(1): Any amino acid
XQEIQTYTIAVINALFLKAPDERRQVDVESNVDILDCPLTEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRIVLENSSREDKHECPF

SEQ ID NO: 27404 - protein, 149 aa, Homo sapiens
  Payload ID: 5404
  Gene Symbol: ELMO1
  Gene Name: engulfment and cell motility 1
  ENSP ID: ENSP00000416090
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKP

SEQ ID NO: 27405 - protein, 720 aa, Homo sapiens
  Payload ID: 5405
  Gene Symbol: ELMO2
  Gene Name: engulfment and cell motility 2
  Uniprot ID: Q96JJ3
  ENSP ID: ENSP00000290246
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 27406 - protein, 718 aa, Homo sapiens
  Payload ID: 5405
  Gene Symbol: ELMO2
  Gene Name: engulfment and cell motility 2
  ENSP ID: ENSP00000326172
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 27407 - protein, 632 aa, Homo sapiens
  Payload ID: 5405
  Gene Symbol: ELMO2
  Gene Name: engulfment and cell motility 2
  Uniprot ID: Q96JJ3
  ENSP ID: ENSP00000361249
MERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 27408 - protein, 720 aa, Homo sapiens; identical to SEQ ID NO: 27405
  Payload ID: 5405
  Gene Symbol: ELMO2
  Gene Name: engulfment and cell motility 2
  Uniprot ID: Q96JJ3
  ENSP ID: ENSP00000379673

SEQ ID NO: 27409 - protein, 267 aa, Homo sapiens
  Payload ID: 5405
  Gene Symbol: ELMO2
  Gene Name: engulfment and cell motility 2
  ENSP ID: ENSP00000388962
EEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVSVSGLL

SEQ ID NO: 27410 - protein, 283 aa, Homo sapiens
  Payload ID: 5405
  Gene Symbol: ELMO2
  Gene Name: engulfment and cell motility 2
  ENSP ID: ENSP00000414329
YHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKNIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 27411 - protein, 338 aa, Homo sapiens
  Payload ID: 5405
  Gene Symbol: ELMO2
  Gene Name: engulfment and cell motility 2
  ENSP ID: ENSP00000416181
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGT

SEQ ID NO: 27412 - protein, 441 aa, Homo sapiens
  Payload ID: 5405
  Gene Symbol: ELMO2
  Gene Name: engulfment and cell motility 2
  ENSP ID: ENSP00000431972
  MOD_RES (1)..(1): Any amino acid
XPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKVSREASLSSWPSDTWRVPLVVVFSRCILGIFPSLFLNVLLRILNIHKNRWNLCIHITQTQQPWPVLPIHLFLSFIALKKVPSITLFHL

SEQ ID NO: 27413 - protein, 756 aa, Homo sapiens
  Payload ID: 5406
  Gene Symbol: ELMO3
  Gene Name: engulfment and cell motility 3
  ENSP ID: ENSP00000354077
MARSSSLGRECGTPRSGLGKGGPPRPQGPQARCTLGRRCTVSGKCRRPRPSWTMAPPRNVVKIAIKMRDAIPQLIQLDQAKPLAAVLKEVCDAWSLTHSERYALQFADGHRRYITENDLEAEQLLGGLQSNSPEGRREALRRLVPLASDMIFAREVISRNGLQILGTIIEDGDDLGEVLALSLRAFSELMEHGVVSWETLSIPFVRKVVCYVNMNLMDASVPPLALGLLESVTLSSPALGQLVKSEVPLDRLLVHLQVMNQQLQTKAMALLTALLQGASPVERKHMLDYLWQRNLRQFIYKNIIHSAAPMGDEMAHHLYVLQALMLGLLEPRMRTPLDPYSQEQREQLQVLRQAAFEVEGESSGAGLSADRRRSLCAREFRKLGFSNSNPAQDLERVPPGLLALDNMLYFSRNAPSAYSRFVLENSSREDKHECPFARGSIQLTVLLCELLRVGEPCSETAQDFSPMFFGQDQSFHELFCVGIQLLNKTWKEMRATQEDFDKVMQVVREQLARTLALKPTSLELFRTKVNALTYGEVLRLRQTERLHQEGTLAPPILELREKLKPELMGLIRQQRLLRLCEGTLFRKISSRRRQDKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 27414 - protein, 773 aa, Homo sapiens
  Payload ID: 5406
  Gene Symbol: ELMO3
  Gene Name: engulfment and cell motility 3
  Uniprot ID: Q96BJ8
  ENSP ID: ENSP00000377566
MARSSSLGRECGTPRSGLGKGGPPRPQGPQARCTLGRRCTVSGKCRRPRPSWTMAPPRNVVKIAIKMRDAIPQLIQLDQAKPLAAVLKEVCDAWSLTHSERYALQFADGHRRYITENNRAEIKNGSILCLSTAPDLEAEQLLGGLQSNSPEGRREALRRLVPLASDMIFAREVISRNGLQILGTIIEDGDDLGEVLALSLRAFSELMEHGVVSWETLSIPFVRKVVCYVNMNLMDASVPPLALGLLESVTLSSPALGQLVKSEVPLDRLLVHLQVMNQQLQTKAMALLTALLQGASPVERKHMLDYLWQRNLRQFIYKNIIHSAAPMGDEMAHHLYVLQALMLGLLEPRMRTPLDPYSQEQREQLQVLRQAAFEVEGESSGAGLSADRRRSLCAREFRKLGFSNSNPAQDLERVPPGLLALDNMLYFSRNAPSAYSRFVLENSSREDKHECPFARGSIQLTVLLCELLRVGEPCSETAQDFSPMFFGQDQSFHELFCVGIQLLNKTWKEMRATQEDFDKVMQVVREQLARTLALKPTSLELFRTKVNALTYGEVLRLRQTERLHQEGTLAPPILELREKLKPELMGLIRQQRLLRLCEGTLFRKISSRRRQDKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 27415 - protein, 607 aa, Homo sapiens
  Payload ID: 5406
  Gene Symbol: ELMO3
  Gene Name: engulfment and cell motility 3
  Uniprot ID: Q96BJ8
  ENSP ID: ENSP00000458539
MIFAREVISRNGLQILGTIIEDGDDLGEVLALSLRAFSELMEHGVVSWETLSIPFVRKVVCYVNMNLMDASVPPLALGLLESVTLSSPALGQLVKSEVPLDRLLVHLQVMNQQLQTKAMALLTALLQGASPVERKHMLDYLWQRNLRQFIYKNIIHSAAPMGDEMAHHLYVLQALMLGLLEPRMRTPLDPYSQEQREQLQVLRQAAFEVEGESSGAGLSADRRRSLCAREFRKLGFSNSNPAQDLERVPPGLLALDNMLYFSRNAPSAYSRFVLENSSREDKHECPFARGSIQLTVLLCELLRVGEPCSETAQDFSPMFFGQDQSFHELFCVGIQLLNKTWKEMRATQEDFDKVMQVVREQLARTLALKPTSLELFRTKVNALTYGEVLRLRQTERLHQEGTLAPPILELREKLKPELMGLIRQQRLLRLCEGTLFRKISSRRRQDKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 27416 - protein, 95 aa, Homo sapiens
  Payload ID: 5406
  Gene Symbol: ELMO3
  Gene Name: engulfment and cell motility 3
  ENSP ID: ENSP00000461166
MARSSSLGRECGTPRSGLGKGGPPRPQGPQARCTLGRRCTVSGKCRRPRPSWTMAPPRNVVKIAIKMRDAIPQLIQLDQAKPLAAVLKEVEPDAL

SEQ ID NO: 27417 - protein, 508 aa, Homo sapiens
  Payload ID: 5407
  Gene Symbol: EDC3
  Gene Name: enhancer of mRNA decapping 3
  Uniprot ID: Q96F86
  ENSP ID: ENSP00000320503
MATDWLGSIVSINCGDSLGVYQGRVSAVDQVSQTISLTRPFHNGVKCLVPEVTFRAGDITELKILEIPGPGDNQHFGDLHQTELGPSGAGCQVGINQNGTGKFVKKPASSSSAPQNIPKRTDVKSQDVAVSPQQQQCSKSYVDRHMESLSQSKSFRRRHNSWSSSSRHPNQATPKKSGLKNGQMKNKDDECFGDDIEEIPDTDFDFEGNLALFDKAAVFEEIDTYERRSGTRSRGIPNERPTRYRHDENILESEPIVYRRIIVPHNVSKEFCTDSGLVVPSISYELHKKLLSVAEKHGLTLERRLEMTGVCASQMALTLLGGPNRLNPKNVHQRPTVALLCGPHVKGAQGISCGRHLANHDVQVILFLPNFVKMLESITNELSLFSKTQGQQVSSLKDLPTSPVDLVINCLDCPENVFLRDQPWYKAAVAWANQNRAPVLSIDPPVHEVEQGIDAKWSLALGLPLPLGEHAGRIYLCDIGIPQQVFQEVGINYHSPFGCKFVIPLHSA

SEQ ID NO: 27418 - protein, 508 aa, Homo sapiens; identical to SEQ ID NO: 27417
  Payload ID: 5407
  Gene Symbol: EDC3
  Gene Name: enhancer of mRNA decapping 3
  Uniprot ID: Q96F86
  ENSP ID: ENSP00000401343

SEQ ID NO: 27419 - protein, 92 aa, Homo sapiens
  Payload ID: 5407
  Gene Symbol: EDC3
  Gene Name: enhancer of mRNA decapping 3
  ENSP ID: ENSP00000454317
MATDWLGSIVSINCGDSLGVYQGRVSAVDQVSQTISLTRPFHNGVKCLVPEVTFRAGDITELKILEIPGPGDNQHFGDLHQTELGPSGAGCQ

SEQ ID NO: 27420 - protein, 57 aa, Homo sapiens
  Payload ID: 5407
  Gene Symbol: EDC3
  Gene Name: enhancer of mRNA decapping 3
  ENSP ID: ENSP00000454885
MATDWLGSIVSINCGDSLGVYQGRVSAVDQVSQTISLTRPFHNGVKCLVPEVTFRVI

SEQ ID NO: 27421 - protein, 213 aa, Homo sapiens
  Payload ID: 5407
  Gene Symbol: EDC3
  Gene Name: enhancer of mRNA decapping 3
  ENSP ID: ENSP00000455393
  MOD_RES (1)..(1): Any amino acid
XEIDTYERRSGTRSRGIPNERPTRYRHDENILESEPIVYRRIIVPHNVSKEFCTDSGLVVPSISYELHKKLLSVAEKHGLTLERRLEMTGVCASQMALTLLGGPNRLNPKNVHQRPTVALLCGPHVKGAQGISCGRHLANHDVQVILFLPNFVKMLESITNELSLFSKTQGQQVSSLKGEHLGRAGLKASSLLSSLMVSSCHPVATGGKALRV

SEQ ID NO: 27422 - protein, 253 aa, Homo sapiens
  Payload ID: 5407
  Gene Symbol: EDC3
  Gene Name: enhancer of mRNA decapping 3
  ENSP ID: ENSP00000455503
MATDWLGSIVSINCGDSLGVYQGRVSAVDQVSQTISLTRPFHNGVKCLVPEVTFRAGDITELKILEIPGPGDNQHFGDLHQTELGPSGAGCQVGINQNGTGKFVKKPASSSSAPQNIPKRTDVKSQDVAVSPQQQQCSKSYVDRHMESLSQSKSFRRRHNSWSSSSRHPNQATPKKSGLKNGQMKNKDDECFGDDIEEIPDTDFDFEGNLALFDKAAVFEEIDTYERRSGTRSRGIPNERPTRYRHDENILES

SEQ ID NO: 27423 - protein, 508 aa, Homo sapiens; identical to SEQ ID NO: 27417
  Payload ID: 5407
  Gene Symbol: EDC3
  Gene Name: enhancer of mRNA decapping 3
  Uniprot ID: Q96F86
  ENSP ID: ENSP00000455580

SEQ ID NO: 27424 - protein, 177 aa, Homo sapiens
  Payload ID: 5407
  Gene Symbol: EDC3
  Gene Name: enhancer of mRNA decapping 3
  ENSP ID: ENSP00000455589
MATDWLGSIVSINCGDSLGVYQGRVSAVDQVSQTISLTRPFHNGVKCLVPEVTFRAGDITELKILEIPGPGDNQHFGDLHQTELGPSGAGCQVGINQNGTGKFVKKPASSSSAPQNIPKRTDVKSQDVAVSPQQQQCSKSYVDRHMESLSQSKSFRRRHNSWSSSSRHPNQATPKKS

SEQ ID NO: 27425 - protein, 31 aa, Homo sapiens
  Payload ID: 5407
  Gene Symbol: EDC3
  Gene Name: enhancer of mRNA decapping 3
  ENSP ID: ENSP00000455682
MATDWLGSIVSINCGDSLGVYQGRVSAVDQV

SEQ ID NO: 27426 - protein, 123 aa, Homo sapiens
  Payload ID: 5407
  Gene Symbol: EDC3
  Gene Name: enhancer of mRNA decapping 3
  ENSP ID: ENSP00000455870
MATDWLGSIVSINCGDSLGVYQGRVSAVDQVSQTISLTRPFHNGVKCLVPEVTFRAGDITELKILEIPGPGDNQHFGDLHQTELGPSGAGCQVGINQNGTGKFVKKPASSSSAPQNIPKRTDV

SEQ ID NO: 27427 - protein, 163 aa, Homo sapiens
  Payload ID: 5407
  Gene Symbol: EDC3
  Gene Name: enhancer of mRNA decapping 3
  ENSP ID: ENSP00000456805
MKNKDDECFGDDIEEIPDTDFDFEGNLALFDKAAVFEEIDTYERRSGTRSRGIPNERPTRYRHDENILESEPIVYRRIIVPHNVSKEFCTDSGLVVPSISYELHKKLLSVAEKHGLTLERRLEMTGVCASQMALTLLGGPNRLNPKNVHQRPTVALLCGPHVK

SEQ ID NO: 27428 - protein, 68 aa, Homo sapiens
  Payload ID: 5407
  Gene Symbol: EDC3
  Gene Name: enhancer of mRNA decapping 3
  ENSP ID: ENSP00000457128
PQNIPKRTDVKSQDVAVSPQQQQCSKSYVDRHMESLSQSKSFRRRHNSYSGLVVPSISYELHKKLLSV

SEQ ID NO: 27429 - protein, 54 aa, Homo sapiens
  Payload ID: 5407
  Gene Symbol: EDC3
  Gene Name: enhancer of mRNA decapping 3
  ENSP ID: ENSP00000457156
MATDWLGSIVSINCGDSLGVYQGRVSAVDQVSQTISLTRPFHNGVKCLVPEVTF

SEQ ID NO: 27430 - protein, 101 aa, Homo sapiens
  Payload ID: 5407
  Gene Symbol: EDC3
  Gene Name: enhancer of mRNA decapping 3
  ENSP ID: ENSP00000457170
MATDWLGSIVSINCGDSLGVYQGRVSAVDQVSQTISLTRPFHNGVKCLVPEVTFRAGDITELKILEIPGPGDNQHFGDLHQTELGPSGAGCQVGINQNGTG

SEQ ID NO: 27431 - protein, 131 aa, Homo sapiens
  Payload ID: 5407
  Gene Symbol: EDC3
  Gene Name: enhancer of mRNA decapping 3
  ENSP ID: ENSP00000457523
MATDWLGSIVSINCGDSLGVYQGRVSAVDQVSQTISLTRPFHNGVKCLVPEVTFRAGDITELKILEIPGPGDNQHFGDLHQTELGPSGAGCQVGINQNGTGKFVKKPASSSSAPQNIPKRTDVKSQDVAVS

SEQ ID NO: 27432 - protein, 1401 aa, Homo sapiens
  Payload ID: 5408
  Gene Symbol: EDC4
  Gene Name: enhancer of mRNA decapping 4
  Uniprot ID: Q6P2E9
  ENSP ID: ENSP00000351811
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQEQRRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 27433 - protein, 154 aa, Homo sapiens
  Payload ID: 5408
  Gene Symbol: EDC4
  Gene Name: enhancer of mRNA decapping 4
  ENSP ID: ENSP00000458357
LPTGKPSRVWCCRPLRRAARPCSSKSMIASGWGHRNALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 27434 - protein, 135 aa, Homo sapiens
  Payload ID: 5408
  Gene Symbol: EDC4
  Gene Name: enhancer of mRNA decapping 4
  ENSP ID: ENSP00000459624
  MOD_RES (1)..(1): Any amino acid
XRAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAEPHNSLGKAARRLSLMLHGLVTPSLP

SEQ ID NO: 27435 - protein, 176 aa, Homo sapiens
  Payload ID: 5408
  Gene Symbol: EDC4
  Gene Name: enhancer of mRNA decapping 4
  ENSP ID: ENSP00000460563
QSATEQMAATVAGSVRAEVQHQLHVAVGSLQESILAQVQRIVKGEAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLH

SEQ ID NO: 27436 - protein, 836 aa, Homo sapiens
  Payload ID: 5409
  Gene Symbol: EPC1
  Gene Name: enhancer of polycomb homolog 1 (Drosophila)
  Uniprot ID: Q9H2F5
  ENSP ID: ENSP00000263062
MSKLSFRARALDASKPLPVFRCEDLPDLHEYASINRAVPQMPTGMEKEEESEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFAFTAEQYQQHQQQLALMQKQQLAQIQQQQANSNSSTNTSQNLASNQQKSGFRLNIQGLERTLQGFVSKTLDSASAQFAASALVTSEQLMGFKMKDDVVLGIGVNGVLPASGVYKGLHLSSTTPTALVHTSPSTAGSALLQPSNITQTSSSHSALSHQVTAANSATTQVLIGNNIRLTVPSSVATVNSIAPINARHIPRTLSAVPSSALKLAAAANCQVSKVPSSSSVDSVPRENHESEKPALNNIADNTVAMEVT

SEQ ID NO: 27437 - protein, 813 aa, Homo sapiens
  Payload ID: 5409
  Gene Symbol: EPC1
  Gene Name: enhancer of polycomb homolog 1 (Drosophila)
  Uniprot ID: Q9H2F5
  ENSP ID: ENSP00000318559
MSKLSFRARALDASKPLPVFRCEDLPDLHEYASINRAVPQMPTGMEKEEESEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFAFTAEQYQQHQQQLALMQKQQLAQIQQQQANSNSSTNTSQGFVSKTLDSASAQFAASALVTSEQLMGFKMKDDVVLGIGVNGVLPASGVYKGLHLSSTTPTALVHTSPSTAGSALLQPSNITQTSSSHSALSHQVTAANSATTQVLIGNNIRLTVPSSVATVNSIAPINARHIPRTLSAVPSSALKLAAAANCQVSKVPSSSSVDSVPRENHESEKPALNNIADNTVAMEVT

SEQ ID NO: 27438 - protein, 763 aa, Homo sapiens
  Payload ID: 5409
  Gene Symbol: EPC1
  Gene Name: enhancer of polycomb homolog 1 (Drosophila)
  Uniprot ID: Q9H2F5
  ENSP ID: ENSP00000364251
MEHHLQRAISAQQVYGEKRDNMVIPVPEAESNIAYYESIYPGEFKMPKQLIHIQPFSLDAEQPDYDLDSEDEVFVNKLKKKMDICPLQFEEMIDRLEKGSGQQPVSLQEAKLLLKEDDELIREVYEYWIKKRKNCRGPSLIPSVKQEKRDGSSTNDPYVAFRRRTEKMQTRKNRKNDEASYEKMLKLRRDLSRAVTILEMIKRREKSKRELLHLTLEIMEKRYNLGDYNGEIMSEVMAQRQPMKPTYAIPIIPITNSSQFKHQEAMDVKEFKVNKQDKADLIRPKRKYEKKPKVLPSSAAATPQQTSPAALPVFNAKDLNQYDFPSSDEEPLSQVLSGSSEAEEDNDPDGPFAFRRKAGCQYYAPHLDQTGNWPWTSPKDGGLGDVRYRYCLTTLTVPQRCIGFARRRVGRGGRVLLDRAHSDYDSVFHHLDLEMLSSPQHSPVNQFANTSETNTSDKSFSKDLSQILVNIKSCRWRHFRPRTPSLHDSDNDELSCRKLYRSINRTGTAQPGTQTCSTSTQSKSSSGSAHFAFTAEQYQQHQQQLALMQKQQLAQIQQQQANSNSSTNTSQGFVSKTLDSASAQFAASALVTSEQLMGFKMKDDVVLGIGVNGVLPASGVYKGLHLSSTTPTALVHTSPSTAGSALLQPSNITQTSSSHSALSHQVTAANSATTQVLIGNNIRLTVPSSVATVNSIAPINARHIPRTLSAVPSSALKLAAAANCQVSKVPSSSSVDSVPRENHESEKPALNNIADNTVAMEVT

SEQ ID NO: 27439 - protein, 807 aa, Homo sapiens
  Payload ID: 5410
  Gene Symbol: EPC2
  Gene Name: enhancer of polycomb homolog 2 (Drosophila)
  Uniprot ID: Q52LR7
  ENSP ID: ENSP00000258484
MSKLSFRARALDAAKPLPIYRGKDMPDLNDCVSINRAVPQMPTGMEKEEESEHHLQRAISAQQVFREKKESMVIPVPEAESNVNYYNRLYKGEFKQPKQFIHIQPFNLDNEQPDYDMDSEDETLLNRLNRKMEIKPLQFEIMIDRLEKASSNQLVTLQEAKLLLNEDDYLIKAVYDYWVRKRKNCRGPSLIPQIKQEKRDGSTNNDPYVAFRRRTEKMQTRKNRKNDEASYEKMLKLRREFSRAITILEMIKRREKTKRELLHLTLEVVEKRYHLGDYGGEILNEVKISRSEKELYATPATLHNGNHHKVQECKTKHPHHLSLKEEASDVVRQKKKYPKKPKAEALITSQQPTPETLPVINKSDIKQYDFHSSDEDEFPQVLSPVSEPEEENDPDGPCAFRRRAGCQYYAPRLDQANHSCENSELADLDKLRYRHCLTTLTVPRRCIGFARRRIGRGGRVIMDRISTEHDPVLKQIDPEMLNSFSSSSQTIDFSSNFSRTNASSKHCENRLSLSEILSNIRSCRLQCFQPRLLNLQDSDSEECTSRKPGQTVNNKRVSAASVALLNTSKNGISVTGGITEEQFQTHQQQLVQMQRQQLAQLQQKQQSQHSSQQTHPKAQGSSTSDCMSKTLDSASAHFAASAVVSAPVPSRSEVAKEQNTGHNNINGVVQPSGTSKTLYSTNMALSSSPGISAVQLVRTVGHTTTNHLIPALCTSSPQTLPMNNSCLTNAVHLNNVSVVSPVNVHINTRTSAPSPTALKLATVAASMDRVPKVTPSSAISSIARENHEPERLGLNGIAETTVAMEVT

SEQ ID NO: 27440 - protein, 160 aa, Homo sapiens
  Payload ID: 5410
  Gene Symbol: EPC2
  Gene Name: enhancer of polycomb homolog 2 (Drosophila)
  ENSP ID: ENSP00000380569
MVIPVPEAESNVNYYNRLYKGEFKQPKQFIHIQPFNLDNEQPDYDMDSEDETLLNRLNRKMEIKPLQFEIMIDRLEKASSNQLVTLQEAKLLLNEDDYLIKAVYDYWVRKRKNCRGPSLIPQIKQEKRDGSTNNDPYVAFRRRTEKMQTRKNRKNDEASY

SEQ ID NO: 27441 - protein, 121 aa, Homo sapiens
  Payload ID: 5410
  Gene Symbol: EPC2
  Gene Name: enhancer of polycomb homolog 2 (Drosophila)
  ENSP ID: ENSP00000387097
MSKLSFRARALDAAKPLPIYRGKDMPDLNDCVSINRAVPQMPTGMEKEEESEHHLQRAISAQQVFREKKESMVIPVPEAESNVNYYNRLYKGEFKQPKQFIHIQLKLHLKLLLFRIEVLFF

SEQ ID NO: 27442 - protein, 126 aa, Homo sapiens
  Payload ID: 5410
  Gene Symbol: EPC2
  Gene Name: enhancer of polycomb homolog 2 (Drosophila)
  ENSP ID: ENSP00000395431
EHHLQRAISAQQVFREKKESMVIPVPEAESNVNYYNRLYKGEFKQPKQFIHIQRIWGHYQPETTLKFLLVCFVHLFLDHSISFNLGCRSAQGSVLRKIFCFSFLPKGKLRNTKFFAFPFCMANLFL

SEQ ID NO: 27443 - protein, 160 aa, Homo sapiens
  Payload ID: 5410
  Gene Symbol: EPC2
  Gene Name: enhancer of polycomb homolog 2 (Drosophila)
  ENSP ID: ENSP00000415543
MPDLNDCVSINRAVPQMPTGMEKEEESEHHLQRAISAQQVFREKKESMVIPVPEAESNVNYYNRLYKGEFKQPKQFIHIQPFNLDNEQPDYDMDSEDETLLNRLNRKMEIKPLQFEIMIDRLEKASSNQLVTLQEAKLLLNEDDYLIKAVYDYWVRKRKN

SEQ ID NO: 27444 - protein, 71 aa, Homo sapiens
  Payload ID: 5411
  Gene Symbol: ERH
  Gene Name: enhancer of rudimentary homolog (Drosophila)
  ENSP ID: ENSP00000450503
MSHTILLVQPTKRPEGRTYADYESVNECMEGVCKMYEEHLKRMNPNSPSITYDISQLFDFIDDLADLSCLV

SEQ ID NO: 27445 - protein, 104 aa, Homo sapiens
  Payload ID: 5411
  Gene Symbol: ERH
  Gene Name: enhancer of rudimentary homolog (Drosophila)
  Uniprot ID: P84090
  ENSP ID: ENSP00000451080
MSHTILLVQPTKRPEGRTYADYESVNECMEGVCKMYEEHLKRMNPNSPSITYDISQLFDFIDDLADLSCLVYRADTQTYQPYNKDWIKEKIYVLLRRQAQQAGK

SEQ ID NO: 27446 - protein, 48 aa, Homo sapiens
  Payload ID: 5412
  Gene Symbol: ENY2
  Gene Name: enhancer of yellow 2 homolog (Drosophila)
  ENSP ID: ENSP00000339861
MNKDAQMRAAINQKLIETGERERLKELLRAKLIECGWKDQLKAHCKGN

SEQ ID NO: 27447 - protein, 51 aa, Homo sapiens
  Payload ID: 5412
  Gene Symbol: ENY2
  Gene Name: enhancer of yellow 2 homolog (Drosophila)
  ENSP ID: ENSP00000428514
MNKDAQMRAAINQKLIETGERERLKELLRAKLIECGWKDQLKAHCKDNDFK

SEQ ID NO: 27448 - protein, 56 aa, Homo sapiens
  Payload ID: 5412
  Gene Symbol: ENY2
  Gene Name: enhancer of yellow 2 homolog (Drosophila)
  ENSP ID: ENSP00000429196
MVVSKMNKDAQMRAAINQKLIETGERERLKELLRAKLIECGWKDQLKAHCKDNDFK

SEQ ID NO: 27449 - protein, 100 aa, Homo sapiens
  Payload ID: 5412
  Gene Symbol: ENY2
  Gene Name: enhancer of yellow 2 homolog (Drosophila)
  ENSP ID: ENSP00000429588
MNKDAQMRAAINQKLIETGERERLKELLRAKLIECGWKDQLKAHCKEVIKEKGLEHVTVDDLVAEITPKGRETGFAMLPRLVLSSRTQAILLPQPSRLLG

SEQ ID NO: 27450 - protein, 53 aa, Homo sapiens
  Payload ID: 5412
  Gene Symbol: ENY2
  Gene Name: enhancer of yellow 2 homolog (Drosophila)
  ENSP ID: ENSP00000429670
MVVSKMNKDAQMRAAINQKLIETGERERLKELLRAKLIECGWKDQLKAHCKGN

SEQ ID NO: 27451 - protein, 96 aa, Homo sapiens
  Payload ID: 5412
  Gene Symbol: ENY2
  Gene Name: enhancer of yellow 2 homolog (Drosophila)
  Uniprot ID: Q9NPA8
  ENSP ID: ENSP00000429713
MNKDAQMRAAINQKLIETGERERLKELLRAKLIECGWKDQLKAHCKEVIKEKGLEHVTVDDLVAEITPKGRALVPDSVKKELLQRIRTFLAQHASL

SEQ ID NO: 27452 - protein, 101 aa, Homo sapiens
  Payload ID: 5412
  Gene Symbol: ENY2
  Gene Name: enhancer of yellow 2 homolog (Drosophila)
  Uniprot ID: Q9NPA8
  ENSP ID: ENSP00000429986
MVVSKMNKDAQMRAAINQKLIETGERERLKELLRAKLIECGWKDQLKAHCKEVIKEKGLEHVTVDDLVAEITPKGRALVPDSVKKELLQRIRTFLAQHASL

SEQ ID NO: 27453 - protein, 747 aa, Homo sapiens
  Payload ID: 5413
  Gene Symbol: EZH1
  Gene Name: enhancer of zeste 1 polycomb repressive complex 2 subunit
  Uniprot ID: Q92800
  ENSP ID: ENSP00000404658
MEIPNPPTSKCITYWKRKVKSEYMRLRQLKRLQANMGAKALYVANFAKVQEKTQILNEEWKKLRVQPVQSMKPVSGHPFLKKCTIESIFPGFASQHMLMRSLNTVALVPIMYSWSPLQQNFMVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 27454 - protein, 738 aa, Homo sapiens
  Payload ID: 5413
  Gene Symbol: EZH1
  Gene Name: enhancer of zeste 1 polycomb repressive complex 2 subunit
  ENSP ID: ENSP00000407869
MEIPNPPTSKCITYWKRKVKSEYMRLRQLKRLQANMGAKALYVANFAKVQEKTQILNEEWKKLRVQPVQSMKPCTIESIFPGFASQHMLMRSLNTVALVPIMYSWSPLQQNFMVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 27455 - protein, 296 aa, Homo sapiens
  Payload ID: 5413
  Gene Symbol: EZH1
  Gene Name: enhancer of zeste 1 polycomb repressive complex 2 subunit
  ENSP ID: ENSP00000464753
MEIPNPPTSKCITYWKRKVKSEYMRLRQLKRLQANMGAKALYVANFAKVQEKTQILNEEWKKLRVQPVQSMKPVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAK

SEQ ID NO: 27456 - protein, 677 aa, Homo sapiens
  Payload ID: 5413
  Gene Symbol: EZH1
  Gene Name: enhancer of zeste 1 polycomb repressive complex 2 subunit
  Uniprot ID: Q92800
  ENSP ID: ENSP00000465220
MKPVSGHPFLKKCTIESIFPGFASQHMLMRSLNTVALVPIMYSWSPLQQNFMVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 27457 - protein, 123 aa, Homo sapiens
  Payload ID: 5413
  Gene Symbol: EZH1
  Gene Name: enhancer of zeste 1 polycomb repressive complex 2 subunit
  ENSP ID: ENSP00000465327
MEIPNPPTSKCITYWKRKVKSEYMRLRQLKRLQANMGAKALYVANFAKVQEKTQILNEEWKKLRVQPVQSMKPVSGHPFLKKCTIESIFPGFASQHMLMRSLNTVALVPIMYSWSPLQQNFMR

SEQ ID NO: 27458 - protein, 125 aa, Homo sapiens
  Payload ID: 5413
  Gene Symbol: EZH1
  Gene Name: enhancer of zeste 1 polycomb repressive complex 2 subunit
  ENSP ID: ENSP00000465423
  MOD_RES (1)..(1): Any amino acid
XEVKEEDETFIEELINNYDGKVHGEEEMIPGSVLISDAVFLELVDALNQYSDEEEEGHNDTSDGKQDDSKEDLPVTRKRKRHAIEGRSKGVCHAPQPPLQVLWSSPEKAPHSQCFLLQCLSLCCG

SEQ ID NO: 27459 - protein, 106 aa, Homo sapiens
  Payload ID: 5413
  Gene Symbol: EZH1
  Gene Name: enhancer of zeste 1 polycomb repressive complex 2 subunit
  ENSP ID: ENSP00000465482
MEIPNPPTSKCITYWKRKVKSEYMRLRQLKRLQANMGAKALYVANFAKVQEKTQILNEEWKKLRVQPVQSMKPVSGHPFLKKCTIESIFPGFASQHMLMRSLNTVA

SEQ ID NO: 27460 - protein, 169 aa, Homo sapiens
  Payload ID: 5413
  Gene Symbol: EZH1
  Gene Name: enhancer of zeste 1 polycomb repressive complex 2 subunit
  ENSP ID: ENSP00000466393
MEIPNPPTSKCITYWKRKVKSEYMRLRQLKRLQANMGAKALYVANFAKVQEKTQILNEEWKKLRVQPVQSMKPVSGHPFLKKVEDETVLCNIPYMGDEVKEEDETFIEELINNYDGKVHGEEEMIPGSVLISDAVFLELVDALNQYSDEEEEGHNDTSDGKQDDSKEDL

SEQ ID NO: 27461 - protein, 747 aa, Homo sapiens; identical to SEQ ID NO: 27453
  Payload ID: 5413
  Gene Symbol: EZH1
  Gene Name: enhancer of zeste 1 polycomb repressive complex 2 subunit
  Uniprot ID: Q92800
  ENSP ID: ENSP00000466924

SEQ ID NO: 27462 - protein, 83 aa, Homo sapiens
  Payload ID: 5413
  Gene Symbol: EZH1
  Gene Name: enhancer of zeste 1 polycomb repressive complex 2 subunit
  ENSP ID: ENSP00000467036
MEIPNPPTSKCITYWKRKVKSEYMRLRQLKRLQANMGAKALYVANFAKVQEKTQILNEEWKKLRVQPVQSMKPVSGHPFLKKR

SEQ ID NO: 27463 - protein, 166 aa, Homo sapiens
  Payload ID: 5413
  Gene Symbol: EZH1
  Gene Name: enhancer of zeste 1 polycomb repressive complex 2 subunit
  ENSP ID: ENSP00000467320
MEIPNPPTSKCITYWKRKVKSEYMRLRQLKRLQANMGAKALYVANFAKVQEKTQILNEEWKKLRVQPVQSMKPVSGHPFLKKCTIESIFPGFASQHMLMRSLNTVALVPIMYSWSPLQQNFMVEDETVLCNIPYMGDEVKEEDETFIEELINNYDGKVHGEEEMIP

SEQ ID NO: 27464 - protein, 707 aa, Homo sapiens
  Payload ID: 5413
  Gene Symbol: EZH1
  Gene Name: enhancer of zeste 1 polycomb repressive complex 2 subunit
  Uniprot ID: Q92800
  ENSP ID: ENSP00000467871
MEIPNPPTSKCITYWKRKVKSEYMRLRQLKRLQANMGAKALYVANFAKVQEKTQILNEEWKKLRVQPVQSMKPVSGHPFLKKVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 27465 - protein, 51 aa, Homo sapiens
  Payload ID: 5413
  Gene Symbol: EZH1
  Gene Name: enhancer of zeste 1 polycomb repressive complex 2 subunit
  ENSP ID: ENSP00000468640
  MOD_RES (1)..(1): Any amino acid
XTRKRKRHAIEGNKKSSKKQFPNDMIFSAIASMFPENGVPDDMKESFSCHP

SEQ ID NO: 27466 - protein, 707 aa, Homo sapiens
  Payload ID: 5414
  Gene Symbol: EZH2
  Gene Name: enhancer of zeste 2 polycomb repressive complex 2 subunit
  Uniprot ID: Q15910
  ENSP ID: ENSP00000223193
MGQTGKKSEKGPVCWRKRVKSEYMRLRQLKRFRRADEVKSMFSSNRQKILERTEILNQEWKQRRIQPVHILTSVSSLRGTREVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 27467 - protein, 751 aa, Homo sapiens
  Payload ID: 5414
  Gene Symbol: EZH2
  Gene Name: enhancer of zeste 2 polycomb repressive complex 2 subunit
  Uniprot ID: Q15910
  ENSP ID: ENSP00000320147
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHRKCNYSFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 27468 - protein, 695 aa, Homo sapiens
  Payload ID: 5414
  Gene Symbol: EZH2
  Gene Name: enhancer of zeste 2 polycomb repressive complex 2 subunit
  Uniprot ID: Q15910
  ENSP ID: ENSP00000417062
MGQTGKKSEKGPVCWRKRVKSEYMRLRQLKRFRRADEVKSMFSSNRQKILERTEILNQEWKQRRIQPVHILTSCSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKGQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 27469 - protein, 334 aa, Homo sapiens
  Payload ID: 5414
  Gene Symbol: EZH2
  Gene Name: enhancer of zeste 2 polycomb repressive complex 2 subunit
  ENSP ID: ENSP00000417377
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLPLLPRN

SEQ ID NO: 27470 - protein, 144 aa, Homo sapiens
  Payload ID: 5414
  Gene Symbol: EZH2
  Gene Name: enhancer of zeste 2 polycomb repressive complex 2 subunit
  ENSP ID: ENSP00000417704
MGQTGKKSEKGPVCWRKRVKSEYMRLRQLKRFRRADEVKSMFSSNRQKILERTEILNQEWKQRRIQPVHILTSVSSLRGTREAIHLLFPLRFSITQFLLGTSLLPRVSVWLCTPTTTIFGLTSLSSSQWSSHTVAYCTSWLIVR

SEQ ID NO: 27471 - protein, 695 aa, Homo sapiens; identical to SEQ ID NO: 27468
  Payload ID: 5414
  Gene Symbol: EZH2
  Gene Name: enhancer of zeste 2 polycomb repressive complex 2 subunit
  Uniprot ID: Q15910
  ENSP ID: ENSP00000419050

SEQ ID NO: 27472 - protein, 746 aa, Homo sapiens
  Payload ID: 5414
  Gene Symbol: EZH2
  Gene Name: enhancer of zeste 2 polycomb repressive complex 2 subunit
  Uniprot ID: Q15910
  ENSP ID: ENSP00000419711
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 27473 - protein, 737 aa, Homo sapiens
  Payload ID: 5414
  Gene Symbol: EZH2
  Gene Name: enhancer of zeste 2 polycomb repressive complex 2 subunit
  Uniprot ID: Q15910
  ENSP ID: ENSP00000419856
MGQTGKKSEKGPVCWRKRVKSEYMRLRQLKRFRRADEVKSMFSSNRQKILERTEILNQEWKQRRIQPVHILTSCSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 27474 - protein, 346 aa, Homo sapiens
  Payload ID: 5415
  Gene Symbol: ENKD1
  Gene Name: enkurin domain containing 1
  Uniprot ID: Q9H0I2
  ENSP ID: ENSP00000243878
MCEGPSRISGPIPPDPTLCPDNYRRPTSAQGRLEGNALKLDLLTSDRALDTTAPRGPCIGPGAGEILERGQRGVGDVLLQLEGISLGPGASLKRKDPKDHEKENLRRIREIQKRFREQERSREQGQPRPLKALWRSPKYDKVESRVKAQLQEPGPASGTESAHFLRAHSRCGPGLPPPHVSSPQPTPPGPEAKEPGLGVDFIRHNARAAKRAPRRHSCSLQVLAQVLEQQRQAQEHYNATQKGHVPHYLLERRDLWRREAEARKQSQPDPAMPPGHTRMPENQRLETLTKLLQSQSQLLRELVLLPAGADSLRAQSHRAELDRKLVQVEEAIKIFSRPKVFVKMDD

SEQ ID NO: 27475 - protein, 225 aa, Homo sapiens
  Payload ID: 5415
  Gene Symbol: ENKD1
  Gene Name: enkurin domain containing 1
  ENSP ID: ENSP00000473501
MCEGPSRISGPIPPDPTLCPDNYRRPTSAQGRLEGNALKLDLLTSDRALDTTAPRGPCIGPGAGEILERGQRGVGDVLLQLEGISLGPGASLKRKDPKDHEKENLRRIREIQKRFREQERSREQGQPRPLKALWRSPKYDKVESRVKAQLQEPGPASGTESAHFLRAHSRCGPGLPPPHVSSPQPTPPGPEAKLVGAQGPVAAGGRGPQAEPAGPCHAPRPHAHA

SEQ ID NO: 27476 - protein, 89 aa, Homo sapiens
  Payload ID: 5415
  Gene Symbol: ENKD1
  Gene Name: enkurin domain containing 1
  ENSP ID: ENSP00000483290
  MOD_RES (1)..(1): Any amino acid
XGDVLLQLEGISLGPGASLKRKDPKDHEKENLRRIREIQKRFREQERSREQGQPRPLKALWRSPKYDKVESRVKAQLQEPGLGVDFIRH

SEQ ID NO: 27477 - protein, 256 aa, Homo sapiens
  Payload ID: 5416
  Gene Symbol: ENKUR
  Gene Name: enkurin, TRPC channel interacting protein
  Uniprot ID: Q8TC29
  ENSP ID: ENSP00000331044
MDPTCSSECIYNLIPSDLKEPPQPPRYISIFKATVKDDMQKAKTAMKTMGPAKVEVPSPKDFLKKHSKEKTLPPKKNFDRNVPKKPAVPLKTDHPVMGIQSGKNFINTNAADIIMGVAKKPKPIYVDKRTGDKHDLEPSGLVPKYINKKDYGVTPEYICKRNEEIKKAQEDYDRYIQENLKKAAMKRLSDEEREAVLQGLKKNWEEVHKEFQSLSVFIDSIPKKIRKQRLEEEMKQLEHDIGIIEKHKIIYIANNA

SEQ ID NO: 27478 - protein, 255 aa, Homo sapiens
  Payload ID: 5416
  Gene Symbol: ENKUR
  Gene Name: enkurin, TRPC channel interacting protein
  ENSP ID: ENSP00000365541
MDPTCSSECIYNLIPSDLKEPPQPPRYISIFKATVKDDMQKAKTAMKTMGPAKVEVPSPKDFLKKHSKEKTLPPKKNFDRNVPKKPAVPLKTDHPVMGIQSGKNFINTNAADIIMGVAKKPKPIYVDKRTGDKHDLEPSGLVPKYINKKDYGVTPEYICKRNEEIKKAQEDYDRYIQENLKKAAMKRLSDEEREAVLQGLKKNWEEVHKEFQSLSVFIDSIPKKIRKQRLEEEMKQLEHDIGIIEKHKIIYIANK

SEQ ID NO: 27479 - protein, 256 aa, Homo sapiens; identical to SEQ ID NO: 27477
  Payload ID: 5416
  Gene Symbol: ENKUR
  Gene Name: enkurin, TRPC channel interacting protein
  Uniprot ID: Q8TC29
  ENSP ID: ENSP00000432930

SEQ ID NO: 27480 - protein, 125 aa, Homo sapiens
  Payload ID: 5416
  Gene Symbol: ENKUR
  Gene Name: enkurin, TRPC channel interacting protein
  ENSP ID: ENSP00000433763
MGIQSGKNFINTNAADIIMGVAKKPKPIYVDKRTGDKHDLEPSGLVPKYINKKDYGVTPEYICKRNEEIKKAQEDYDRYIQENLKKAAMKRLSDEEREAVLQGLKKNWEEVHKEFQSLSVFIDSI

SEQ ID NO: 27481 - protein, 194 aa, Homo sapiens
  Payload ID: 5416
  Gene Symbol: ENKUR
  Gene Name: enkurin, TRPC channel interacting protein
  ENSP ID: ENSP00000478989
MKTERVTGGGSPEKNFDRNVPKKPAVPLKTDHPVMGIQSGKNFINTNAADIIMGVAKKPKPIYVDKRTGDKHDLEPSGLVPKYINKKDYGVTPEYICKRNEEIKKAQEDYDRYIQENLKKAAMKRLSDEEREAVLQGLKKNWEEVHKEFQSLSVFIDSIPKKIRKQRLEEEMKQLEHDIGIIEKHKIIYIANNA

SEQ ID NO: 27482 - protein, 434 aa, Homo sapiens
  Payload ID: 5417
  Gene Symbol: ENO1
  Gene Name: enolase 1, (alpha)
  Uniprot ID: P06733
  ENSP ID: ENSP00000234590
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 27483 - protein, 195 aa, Homo sapiens
  Payload ID: 5417
  Gene Symbol: ENO1
  Gene Name: enolase 1, (alpha)
  ENSP ID: ENSP00000466406
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNV

SEQ ID NO: 27484 - protein, 17 aa, Homo sapiens
  Payload ID: 5417
  Gene Symbol: ENO1
  Gene Name: enolase 1, (alpha)
  ENSP ID: ENSP00000468392
MSILKIHAREIFDSRGN

SEQ ID NO: 27485 - protein, 434 aa, Homo sapiens
  Payload ID: 5418
  Gene Symbol: ENO2
  Gene Name: enolase 2 (gamma, neuronal)
  Uniprot ID: P09104
  ENSP ID: ENSP00000229277
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 27486 - protein, 434 aa, Homo sapiens; identical to SEQ ID NO: 27485
  Payload ID: 5418
  Gene Symbol: ENO2
  Gene Name: enolase 2 (gamma, neuronal)
  Uniprot ID: P09104
  ENSP ID: ENSP00000437402

SEQ ID NO: 27487 - protein, 315 aa, Homo sapiens
  Payload ID: 5418
  Gene Symbol: ENO2
  Gene Name: enolase 2 (gamma, neuronal)
  ENSP ID: ENSP00000438062
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSLELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 27488 - protein, 434 aa, Homo sapiens; identical to SEQ ID NO: 27485
  Payload ID: 5418
  Gene Symbol: ENO2
  Gene Name: enolase 2 (gamma, neuronal)
  Uniprot ID: P09104
  ENSP ID: ENSP00000438873

SEQ ID NO: 27489 - protein, 391 aa, Homo sapiens
  Payload ID: 5418
  Gene Symbol: ENO2
  Gene Name: enolase 2 (gamma, neuronal)
  Uniprot ID: P09104
  ENSP ID: ENSP00000441490
MSIEKIWAREILDSRGNPTVEVDLYTAKGLFRAAVPSGASTGIYEALELRDGDKQRYLGKAKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 27490 - protein, 103 aa, Homo sapiens
  Payload ID: 5418
  Gene Symbol: ENO2
  Gene Name: enolase 2 (gamma, neuronal)
  ENSP ID: ENSP00000445788
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENK

SEQ ID NO: 27491 - protein, 73 aa, Homo sapiens
  Payload ID: 5418
  Gene Symbol: ENO2
  Gene Name: enolase 2 (gamma, neuronal)
  ENSP ID: ENSP00000476096
LVKEAIDKAGYTEKIVIGMDVAASEFYRDGKYDLDFKSPTDPSRYITGDQLGALYQDFVRDYPGNKGACSCLM

SEQ ID NO: 27492 - protein, 86 aa, Homo sapiens
  Payload ID: 5418
  Gene Symbol: ENO2
  Gene Name: enolase 2 (gamma, neuronal)
  ENSP ID: ENSP00000476112
  MOD_RES (1)..(1): Any amino acid
XVSIEDPFDQDDWAAWSKFTANVGIQIVGDDLTVTNPKRIERAVEEKACNCLLLKVNQIGSVTEAIQASRLVPRAVLNVWLNTTSS

SEQ ID NO: 27493 - protein, 434 aa, Homo sapiens
  Payload ID: 5419
  Gene Symbol: ENO3
  Gene Name: enolase 3 (beta, muscle)
  Uniprot ID: P13929
  ENSP ID: ENSP00000324105
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 27494 - protein, 148 aa, Homo sapiens
  Payload ID: 5419
  Gene Symbol: ENO3
  Gene Name: enolase 3 (beta, muscle)
  ENSP ID: ENSP00000428502
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVP

SEQ ID NO: 27495 - protein, 154 aa, Homo sapiens
  Payload ID: 5419
  Gene Symbol: ENO3
  Gene Name: enolase 3 (beta, muscle)
  ENSP ID: ENSP00000428811
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVIN

SEQ ID NO: 27496 - protein, 283 aa, Homo sapiens
  Payload ID: 5419
  Gene Symbol: ENO3
  Gene Name: enolase 3 (beta, muscle)
  ENSP ID: ENSP00000430055
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSF

SEQ ID NO: 27497 - protein, 58 aa, Homo sapiens
  Payload ID: 5419
  Gene Symbol: ENO3
  Gene Name: enolase 3 (beta, muscle)
  ENSP ID: ENSP00000430554
MAMQKIFAREILDSRGNPTVEVDLHTAKDFFPSPLLPTWNQSWKLGEAGVSLCTASCP

SEQ ID NO: 27498 - protein, 391 aa, Homo sapiens
  Payload ID: 5419
  Gene Symbol: ENO3
  Gene Name: enolase 3 (beta, muscle)
  Uniprot ID: P13929
  ENSP ID: ENSP00000430636
MAMQKIFAREILDSRGNPTVEVDLHTAKGRFRAAVPSGASTGIYEALELRDGDKGRYLGKAKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 27499 - protein, 434 aa, Homo sapiens; identical to SEQ ID NO: 27493
  Payload ID: 5419
  Gene Symbol: ENO3
  Gene Name: enolase 3 (beta, muscle)
  Uniprot ID: P13929
  ENSP ID: ENSP00000431087

SEQ ID NO: 27500 - protein, 148 aa, Homo sapiens; identical to SEQ ID NO: 27494
  Payload ID: 5419
  Gene Symbol: ENO3
  Gene Name: enolase 3 (beta, muscle)
  ENSP ID: ENSP00000464874

SEQ ID NO: 27501 - protein, 212 aa, Homo sapiens
  Payload ID: 5419
  Gene Symbol: ENO3
  Gene Name: enolase 3 (beta, muscle)
  ENSP ID: ENSP00000465697
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGG

SEQ ID NO: 27502 - protein, 28 aa, Homo sapiens
  Payload ID: 5419
  Gene Symbol: ENO3
  Gene Name: enolase 3 (beta, muscle)
  ENSP ID: ENSP00000467270
MAMQKIFAREILDSRGNPTVEVDLHTAK

SEQ ID NO: 27503 - protein, 196 aa, Homo sapiens
  Payload ID: 5419
  Gene Symbol: ENO3
  Gene Name: enolase 3 (beta, muscle)
  ENSP ID: ENSP00000467444
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVI

SEQ ID NO: 27504 - protein, 625 aa, Homo sapiens
  Payload ID: 5420
  Gene Symbol: ENO4
  Gene Name: enolase family member 4
  ENSP ID: ENSP00000345555
MEEEGGGRSCGTTRELQKLKQQAMEYYRENDVPRRLEELLNSTFYLQPADVYGHLANCFSKLAKPPTICKIVGKDVLDGLGLPTLQVDIFCTIQNFPKNVCSVVISTHFEVHENALPELAKAEEAERASAVSTAVQWVNSTITHELQGMAPSDQAEVDHLLRIFFASKVQEDKGRKELEKSLEYSTVPTPLPPVPPPPPPPPPTKKKGQKPGRKDTITEKPIAPAEPVEPVLSGSMAIGAVSLAVAKACAMLLNKPLYLNIALLKHNQEQPTTLSMPLLMVSLVSCGKSSSGKLNLMKEVICIPHPELTTKQGVEMLMEMQKHINKIIEMPSPPKAETKKGHDGSKRGQQQITGKMSHLGCLTINCDSIEQPLLLIQEICANLGLELGTNLHLAINCAGHELMDYNKGKYEVIMGTYKNAAEMVDLYVDLINKYPSIIALIDPFRKEDSEQWDSIYHALGSRCYIIAGTASKSISKLLEQGNISIPKSNGLIIKHTNQTTMSDLVEITNLIDSKKHITVFGSTEGESSDDSLVDLAVGLGVRFIKLGGLSRGERVTKYNRLLTIEEELVQNGTLGFKEEHTFFYFNEEAEKAAEALEAAAAREPLVPTFPTQGVEESAETGASSG

SEQ ID NO: 27505 - protein, 363 aa, Homo sapiens
  Payload ID: 5420
  Gene Symbol: ENO4
  Gene Name: enolase family member 4
  ENSP ID: ENSP00000358208
MAIGAVSLAVAKACAMLLNKPLYLNIALLKHNQEQPTTLSMPLLMVSLVSCGKSSSGKLNLMKEVICIPHPELTTKQGVEMLMEMQKHINKIIEMPSPPKAETKKGHDGSKRGQQQITGKMSHLGCLTINCDSIEQPLLLIQEICANLGLELGTNLHLAINCAGHELMDYNKGKYEVIMGTYKNAAEMVDLYVDLINKYPSIIALIDPFRKEDSEQWDSIYHALGSRCYIIAGTASKSISKLLEQGNISIPKSNGLIIKHTNQTTMSDLVEITNLIDSKKHITVFGSTEGESSDDSLVDLAVGLGVRFIKLGGLSRGERVTKYNRLLTIEEELVQNGTLATSSSSCDARIGGQEQETMTLVKV

SEQ ID NO: 27506 - protein, 308 aa, Homo sapiens
  Payload ID: 5420
  Gene Symbol: ENO4
  Gene Name: enolase family member 4
  Uniprot ID: A6NNW6
  ENSP ID: ENSP00000387194
MEEEGGGRSCGTTRELQKLKQQAMEYYRENDVPRRLEELLNSTFYLQPADVYGHLPSPPKAETKKGHDGSKRGQQQITGKMSHLGCLTINCDSIEQPLLLIQEICANLGLELGTNLHLAINCAGHELMDYDSEQWDSIYHALGSRCYIIAGTASKSISKLLEQGNISIPKSNGLIIKHTNQTTMSDLVEITNLIDSKKHITVFGSTEGESSDDSLVDLAVGLGVRFIKLGGLSRGERVTKYNRLLTIEEELVQNGTLGFKEEHTFFYFNEEAEKAAEALEAAAAREPLVPTFPTQGVEESAETGASSG

SEQ ID NO: 27507 - protein, 138 aa, Homo sapiens
  Payload ID: 5420
  Gene Symbol: ENO4
  Gene Name: enolase family member 4
  ENSP ID: ENSP00000474839
  MOD_RES (1)..(1): Any amino acid
XGRSCGTTRELQKLKQQAMEYYRENDVPRRLEELLNSTFYLQPADVYGHLANCFSKLAKPPTICKIVGKDVLDGLGLPTLQVDIFCTIQNFPKNVCSVVISTHFEVHENALPELAKAEEAERASAVSTAVQWVNSTIT

SEQ ID NO: 27508 - protein, 628 aa, Homo sapiens [sequence omitted]

SEQ ID NO: 27509 - protein, 443 aa, Homo sapiens
  Payload ID: 5421
  Gene Symbol: ENOSF1
  Gene Name: enolase superfamily member 1
  Uniprot ID: Q7L5Y1
  ENSP ID: ENSP00000251101
MVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 27510 - protein, 450 aa, Homo sapiens
  Payload ID: 5421
  Gene Symbol: ENOSF1
  Gene Name: enolase superfamily member 1
  Uniprot ID: Q7L5Y1
  ENSP ID: ENSP00000345974
MVSADAMVSADAMVSADAMVSADAMVSADAMVSADAMVSADAMVSADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 27511 - protein, 361 aa, Homo sapiens
  Payload ID: 5421
  Gene Symbol: ENOSF1
  Gene Name: enolase superfamily member 1
  Uniprot ID: Q7L5Y1
  ENSP ID: ENSP00000373072
MQKMESRGVELPSLWEKALKLIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 27512 - protein, 96 aa, Homo sapiens
  Payload ID: 5421
  Gene Symbol: ENOSF1
  Gene Name: enolase superfamily member 1
  ENSP ID: ENSP00000462925
  MOD_RES (1)..(1): Any amino acid
XHGADAMHTDPDYSAAYVVIETDAEDGIKGCGITFTLGKGTEVDWSRKGRGAPGDSGRPKRGVGLVGQAGGKACLEVTCGHGSQDAGILHRFQVHH

SEQ ID NO: 27513 - protein, 367 aa, Homo sapiens
  Payload ID: 5421
  Gene Symbol: ENOSF1
  Gene Name: enolase superfamily member 1
  ENSP ID: ENSP00000463425
MVRGRISRLSVRDVRFPTSLGGHGADAMHTDPDYSAAYVVIETDAEDGIKGCGITFTLGKGTEVDWSRKGRGAPGDSGRPKRGVGLVGQAGGKACLEVTCGHEKQMLAQGYPAYTTSCAWLGYSDDTLKQLCAQALKDGWTRFKVKVGADLQDDMRRCQIIRDMIGPEKTLMMDANQRWDVPEAVEWMSKLAKFKPLWIEEPTSPDDILGHATISKALVPLGIGIATGEQCHNRVIFKQLLQAKALQFLQIDSCRLGSVNENLSVLLMAKKFEIPVCPHAGGVGLCELVQHLIIFDYISVSASLENRVCEYVDHLHEHFKYPVMIQRASYMPPKDPGYSTEMKEESVKKHQYPDGEVWKKLLPAQEN

SEQ ID NO: 27514 - protein, 179 aa, Homo sapiens
  Payload ID: 5421
  Gene Symbol: ENOSF1
  Gene Name: enolase superfamily member 1
  ENSP ID: ENSP00000463448
MVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMKYCRKVKLVKKKERSKCWHKDTLLTRHRAPGWGTQMTR

SEQ ID NO: 27515 - protein, 204 aa, Homo sapiens
  Payload ID: 5421
  Gene Symbol: ENOSF1
  Gene Name: enolase superfamily member 1
  ENSP ID: ENSP00000464614
MVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMGRIRRTAGLSRGNSLATGTSNSEGPWKVQNVDGAVFSQRSKCWHKDTLLTRHRAPGWGTQMTR

SEQ ID NO: 27516 - protein, 98 aa, Homo sapiens
  Payload ID: 5421
  Gene Symbol: ENOSF1
  Gene Name: enolase superfamily member 1
  ENSP ID: ENSP00000473632
MIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYS

SEQ ID NO: 27517 - protein, 261 aa, Homo sapiens
  Payload ID: 5422
  Gene Symbol: ENOPH1
  Gene Name: enolase-phosphatase 1
  Uniprot ID: Q9UHY7
  ENSP ID: ENSP00000273920
MVVLSVPAEVTVILLDIEGTTTPIAFVKDILFPYIEENVKEYLQTHWEEEECQQDVSLLRKQAEEDAHLDGAVPIPAASGNGVDDLQQMIQAVVDNVCWQMSLDRKTTALKQLQGHMWRAAFTAGRMKAEFFADVVPAVRKWREAGMKVYIYSSGSVEAQKLLFGHSTEGDILELVDGHFDTKIGHKVESESYRKIADSIGCSTNNILFLTDVTREASAAEEADVHVAVVVRPGNAGLTDDEKTYYSLITSFSELYLPSST

SEQ ID NO: 27518 - protein, 173 aa, Homo sapiens
  Payload ID: 5422
  Gene Symbol: ENOPH1
  Gene Name: enolase-phosphatase 1
  ENSP ID: ENSP00000422005
MIQAVVDNVCWQMSLDRKTTALKQLQGHMWRAAFTAGRMKAEFFADVVPAVRKWREAGMKVYIYSSGSVEAQKLLFGHSTEGDILELVDGHFDTKIGHKVESESYRKIADSIGCSTNNILFLTDVTREASAAEEADVHVAVVVRPGNAGLTDDEKTYYSLITSFSELYLPSST

SEQ ID NO: 27519 - protein, 115 aa, Homo sapiens
  Payload ID: 5422
  Gene Symbol: ENOPH1
  Gene Name: enolase-phosphatase 1
  Uniprot ID: Q9UHY7
  ENSP ID: ENSP00000427209
MKVYIYSSGSVEAQKLLFGHSTEGDILELVDGHFDTKIGHKVESESYRKIADSIGCSTNNILFLTDVTREASAAEEADVHVAVVVRPGNAGLTDDEKTYYSLITSFSELYLPSST

SEQ ID NO: 27520 - protein, 207 aa, Homo sapiens
  Payload ID: 5422
  Gene Symbol: ENOPH1
  Gene Name: enolase-phosphatase 1
  ENSP ID: ENSP00000477863
MVVLSVPAEVTVILLDIEGTTTPIAFVKDILFPYIEENVKEYLQTHWEEEECQQDVSLLRKQAEEDAHLDGAVPIPAASGNGVDDLQQMIQAVVDNVCWQMSLDRKTTALKQLQGHMWRAAFTAGRMKAEFFADVVPAVRKWREAGMKVYIYSSGSVEAQKLLFGHSTEGDILELVDGHFDTKIGHKVESLPKDCRQHWVLNQTFCF

SEQ ID NO: 27521 - protein, 149 aa, Homo sapiens [sequence omitted]

SEQ ID NO: 27522 - protein, 328 aa, Homo sapiens
  Payload ID: 5423
  Gene Symbol: ECH1
  Gene Name: enoyl CoA hydratase 1, peroxisomal
  Uniprot ID: Q13011
  ENSP ID: ENSP00000221418
MAAGIVASRRLRDLLTRRLTGSNYPGLSISLRLTGSSAQEEASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVKEVDVGLAADVGTLQRLPKVIGNQSLVNELAFTARKMMADEALGSGLVSRVFPDKEVMLDAALALAAEISSKSPVAVQSTKVNLLYSRDHSVAESLNYVASWNMSMLQTQDLVKSVQATTENKELKTVTFSKL

SEQ ID NO: 27523 - protein, 36 aa, Homo sapiens
  Payload ID: 5423
  Gene Symbol: ECH1
  Gene Name: enoyl CoA hydratase 1, peroxisomal
  ENSP ID: ENSP00000469354
MNKVFWREMVECFNKISRDADCRAVVISGAGKMFTA

SEQ ID NO: 27524 - protein, 69 aa, Homo sapiens
  Payload ID: 5423
  Gene Symbol: ECH1
  Gene Name: enoyl CoA hydratase 1, peroxisomal
  ENSP ID: ENSP00000470519
RRLRDLLTRRESPLALWGCVALSCCYSRCRTGRAIRGHEGPESPKFRGLTGSNYPGLSISLRLTGSSAQ

SEQ ID NO: 27525 - protein, 181 aa, Homo sapiens
  Payload ID: 5423
  Gene Symbol: ECH1
  Gene Name: enoyl CoA hydratase 1, peroxisomal
  ENSP ID: ENSP00000470809
MAAGIVASRRLRDLLTRRLTGSNYPGLSISLRLTGSSAQEEASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQETFNVIERCPKPVIAAVHGGCIGGGESAAIL

SEQ ID NO: 27526 - protein, 37 aa, Homo sapiens
  Payload ID: 5423
  Gene Symbol: ECH1
  Gene Name: enoyl CoA hydratase 1, peroxisomal
  ENSP ID: ENSP00000470839
MAAGIVASRRLRDLLTRRESPLALWGTDRLQLPGTQY

SEQ ID NO: 27527 - protein, 55 aa, Homo sapiens
  Payload ID: 5423
  Gene Symbol: ECH1
  Gene Name: enoyl CoA hydratase 1, peroxisomal
  ENSP ID: ENSP00000471738
MAAGIVASRRLRDLLTRRESPLALWGEMVECFNKISRDADCRAVVISGAGKMFTA

SEQ ID NO: 27528 - protein, 267 aa, Homo sapiens
  Payload ID: 5423
  Gene Symbol: ECH1
  Gene Name: enoyl CoA hydratase 1, peroxisomal
  ENSP ID: ENSP00000472322
  MOD_RES (1)..(1): Any amino acid
XIVASRRLRDLLTRRLTGSNYPGLSISLRLTGSSAQEEASGVALGEAPDHSYESLRVTSAQKHVLHVQLNRPNKRNAMNKVFWREMVECFNKISRDADCRAVVISGAGKMFTAGIDLMDMASDILQPKGDDVARISWYLRDIITRYQETFNVIERCPKPVIAAVHGGCIGGGVDLVTACDIRYCAQDAFFQVKEVDVGLAADVGTLQRLPKVIGNQSRVFPDKEVMLDAALALAAEISSKSPVAVQSTKVNLLYSRDHSVAESLNYV

SEQ ID NO: 27529 - protein, 17 aa, Homo sapiens
  Payload ID: 5423
  Gene Symbol: ECH1
  Gene Name: enoyl CoA hydratase 1, peroxisomal
  ENSP ID: ENSP00000472378
MNKVFWREMVECFNKIS

SEQ ID NO: 27530 - protein, 261 aa, Homo sapiens
  Payload ID: 5424
  Gene Symbol: ECHDC2
  Gene Name: enoyl CoA hydratase domain containing 2
  Uniprot ID: Q86YB7
  ENSP ID: ENSP00000351125
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 27531 - protein, 65 aa, Homo sapiens
  Payload ID: 5424
  Gene Symbol: ECHDC2
  Gene Name: enoyl CoA hydratase domain containing 2
  ENSP ID: ENSP00000360575
MLRVLCLLRPWRPLRARGCASDGAAGGSEIQVRALAGPDQGKCAVPGRRMTRLGLGRRQRGTGRL

SEQ ID NO: 27532 - protein, 292 aa, Homo sapiens
  Payload ID: 5424
  Gene Symbol: ECHDC2
  Gene Name: enoyl CoA hydratase domain containing 2
  Uniprot ID: Q86YB7
  ENSP ID: ENSP00000360577
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIAAFPAPTIAAMDGFALGGGLELALACDLRVAASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 27533 - protein, 43 aa, Homo sapiens
  Payload ID: 5424
  Gene Symbol: ECHDC2
  Gene Name: enoyl CoA hydratase domain containing 2
  ENSP ID: ENSP00000438535
MLRVLCLLRPWRPLRARGCASDGAAGGSEIQVRALAGPDQAGH

SEQ ID NO: 27534 - protein, 244 aa, Homo sapiens
  Payload ID: 5424
  Gene Symbol: ECHDC2
  Gene Name: enoyl CoA hydratase domain containing 2
  ENSP ID: ENSP00000439264
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQVDIASGMAIEGMCYAQNIPTRDRLEGMAAFREKRTPKFVGK

SEQ ID NO: 27535 - protein, 49 aa, Homo sapiens
  Payload ID: 5424
  Gene Symbol: ECHDC2
  Gene Name: enoyl CoA hydratase domain containing 2
  ENSP ID: ENSP00000439906
MLRVLCLLRPWRPLRARGCASDGAAGGSEIQVRALAGPDQGCRFHEDRP

SEQ ID NO: 27536 - protein, 219 aa, Homo sapiens
  Payload ID: 5424
  Gene Symbol: ECHDC2
  Gene Name: enoyl CoA hydratase domain containing 2
  ENSP ID: ENSP00000441962
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQVDIASGMAIEGMCYAQ

SEQ ID NO: 27537 - protein, 48 aa, Homo sapiens
  Payload ID: 5424
  Gene Symbol: ECHDC2
  Gene Name: enoyl CoA hydratase domain containing 2
  ENSP ID: ENSP00000446190
MLRVLCLLRPWRPLRARGCASDGAAGGSEIQVRALAGPDQDKAEDPGR

SEQ ID NO: 27538 - protein, 303 aa, Homo sapiens
  Payload ID: 5425
  Gene Symbol: ECHDC3
  Gene Name: enoyl CoA hydratase domain containing 3
  Uniprot ID: Q96DC8
  ENSP ID: ENSP00000368517
MAAVAVLRAFGASGPMCLRRGPWAQLPARFCSRDPAGAGRRESEPRPTSARQLDGIRNIVLSNPKKRNALSLAMLKSLQSDILHDADSNDLKVIIISAEGPVFSSGHDLKELTEEQGRDYHAEVFQTCSKVMMHIRNHPVPVIAMVNGLAAAAGCQLVASCDIAVASDKSSFATPGVNVGLFCSTPGVALARAVPRKVALEMLFTGEPISAQEALLHGLLSKVVPEAELQEETMRIARKIASLSRPVVSLGKATFYKQLPQDLGTAYYLTSQAMVDNLALRDGQEGITAFLQKRKPVWSHEPV

SEQ ID NO: 27539 - protein, 166 aa, Homo sapiens
  Payload ID: 5425
  Gene Symbol: ECHDC3
  Gene Name: enoyl CoA hydratase domain containing 3
  ENSP ID: ENSP00000398429
MLKSLQSDILHDADSNDLKVIIISAEGPVFSSGHDLKELTEEQGRDYHAEVFQTCSKVMMHIRNHPVPVIAMVNGLAAAAGCQLVASCDIAVASDKSSFATPGVNVGLFCSTPGVALARAVPRKVALEMLFTGEPISAQEALLHGLLSKVVPEAELQEETMRIARK

SEQ ID NO: 27540 - protein, 241 aa, Homo sapiens
  Payload ID: 5425
  Gene Symbol: ECHDC3
  Gene Name: enoyl CoA hydratase domain containing 3
  ENSP ID: ENSP00000405584
MAAVAVLRAFGASGPMCLRRGPWAQLPARFCSRDPAGAGRRESEPRPTSARQLDGIRSAPGRAGSSRWCRVGVRAPPLTRGGPGEPEPRLRPWGGNSPCPGPGPGSETRRNIVLSNPKKRNALSLAMLKSLQSDILHDADSNDLKVIIISAEGPVFSSGHDLKELTEEQGRDYHAEVFQTCSKVMMHIRNHPVPVIAMVNGLAAAAGCQLVASCDIAVASDKSSFATPGVNVGLFCSTPGV

SEQ ID NO: 27541 - protein, 290 aa, Homo sapiens
  Payload ID: 5426
  Gene Symbol: ECHS1
  Gene Name: enoyl CoA hydratase, short chain, 1, mitochondrial
  Uniprot ID: P30084
  ENSP ID: ENSP00000357535
MAALRVLLSCVRGPLRPPVRCPAWRPFASGANFEYIIAEKRGKNNTVGLIQLNRPKALNALCDGLIDELNQALKTFEEDPAVGAIVLTGGDKAFAAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAQDAKQAGLVSKICPVETLVEEAIQCAEKIASNSKIVVAMAKESVNAAFEMTLTEGSKLEKKLFYSTFATDDRKEGMTAFVEKRKANFKDQ

SEQ ID NO: 27542 - protein, 302 aa, Homo sapiens
  Payload ID: 5427
  Gene Symbol: ECI1
  Gene Name: enoyl-CoA delta isomerase 1
  Uniprot ID: P42126
  ENSP ID: ENSP00000301729
MALVASVRVPARVLLRAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 27543 - protein, 285 aa, Homo sapiens
  Payload ID: 5427
  Gene Symbol: ECI1
  Gene Name: enoyl-CoA delta isomerase 1
  Uniprot ID: P42126
  ENSP ID: ENSP00000456319
MALVASVRVPARVLLRAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 27544 - protein, 224 aa, Homo sapiens
  Payload ID: 5427
  Gene Symbol: ECI1
  Gene Name: enoyl-CoA delta isomerase 1
  ENSP ID: ENSP00000456565
MKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISK

SEQ ID NO: 27545 - protein, 243 aa, Homo sapiens
  Payload ID: 5427
  Gene Symbol: ECI1
  Gene Name: enoyl-CoA delta isomerase 1
  ENSP ID: ENSP00000457900
MKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 27546 - protein, 364 aa, Homo sapiens
  Payload ID: 5428
  Gene Symbol: ECI2
  Gene Name: enoyl-CoA delta isomerase 2
  ENSP ID: ENSP00000354737
MNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 27547 - protein, 394 aa, Homo sapiens
  Payload ID: 5428
  Gene Symbol: ECI2
  Gene Name: enoyl-CoA delta isomerase 2
  Uniprot ID: O75521
  ENSP ID: ENSP00000369461
MAMAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 27548 - protein, 152 aa, Homo sapiens
  Payload ID: 5428
  Gene Symbol: ECI2
  Gene Name: enoyl-CoA delta isomerase 2
  ENSP ID: ENSP00000369463
MAMAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKVLVISIVTFSKCLFIDHGLRLFVIVRSGSCQAELCGFGVQFESFIGIL

SEQ ID NO: 27549 - protein, 364 aa, Homo sapiens; identical to SEQ ID NO: 27546
  Payload ID: 5428
  Gene Symbol: ECI2
  Gene Name: enoyl-CoA delta isomerase 2
  ENSP ID: ENSP00000369468

SEQ ID NO: 27550 - protein, 140 aa, Homo sapiens
  Payload ID: 5428
  Gene Symbol: ECI2
  Gene Name: enoyl-CoA delta isomerase 2
  ENSP ID: ENSP00000417170
MNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEEGW

SEQ ID NO: 27551 - protein, 220 aa, Homo sapiens
  Payload ID: 5428
  Gene Symbol: ECI2
  Gene Name: enoyl-CoA delta isomerase 2
  ENSP ID: ENSP00000417459
MGASGGQGYGSLSAVPKVSACLRARSHPPGAGLRAGEPPQLSTRACTSQPGCFWGAKRRLLKASSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIM

SEQ ID NO: 27552 - protein, 197 aa, Homo sapiens
  Payload ID: 5428
  Gene Symbol: ECI2
  Gene Name: enoyl-CoA delta isomerase 2
  ENSP ID: ENSP00000417803
MAMAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNISYTI

SEQ ID NO: 27553 - protein, 364 aa, Homo sapiens; identical to SEQ ID NO: 27546
  Payload ID: 5428
  Gene Symbol: ECI2
  Gene Name: enoyl-CoA delta isomerase 2
  ENSP ID: ENSP00000420309

SEQ ID NO: 27554 - protein, 17 aa, Homo sapiens
  Payload ID: 5429
  Gene Symbol: ECH1
  Gene Name: Enoyl-CoA hydratase 1, peroxisomal
  ENSP ID: ENSP00000488977
MNKVFWREMVECFNKIS

SEQ ID NO: 27555 - protein, 69 aa, Homo sapiens; identical to SEQ ID NO: 27524
  Payload ID: 5429
  Gene Symbol: ECH1
  Gene Name: Enoyl-CoA hydratase 1, peroxisomal
  ENSP ID: ENSP00000489210

SEQ ID NO: 27556 - protein, 37 aa, Homo sapiens; identical to SEQ ID NO: 27526
  Payload ID: 5429
  Gene Symbol: ECH1
  Gene Name: Enoyl-CoA hydratase 1, peroxisomal
  ENSP ID: ENSP00000489283

SEQ ID NO: 27557 - protein, 36 aa, Homo sapiens; identical to SEQ ID NO: 27523
  Payload ID: 5429
  Gene Symbol: ECH1
  Gene Name: Enoyl-CoA hydratase 1, peroxisomal
  ENSP ID: ENSP00000489296

SEQ ID NO: 27558 - protein, 55 aa, Homo sapiens; identical to SEQ ID NO: 27527
  Payload ID: 5429
  Gene Symbol: ECH1
  Gene Name: Enoyl-CoA hydratase 1, peroxisomal
  ENSP ID: ENSP00000489301

SEQ ID NO: 27559 - protein, 181 aa, Homo sapiens; identical to SEQ ID NO: 27525
  Payload ID: 5429
  Gene Symbol: ECH1
  Gene Name: Enoyl-CoA hydratase 1, peroxisomal
  ENSP ID: ENSP00000489400

SEQ ID NO: 27560 - protein, 328 aa, Homo sapiens; identical to SEQ ID NO: 27522
  Payload ID: 5429
  Gene Symbol: ECH1
  Gene Name: Enoyl-CoA hydratase 1, peroxisomal
  ENSP ID: ENSP00000489530

SEQ ID NO: 27561 - protein, 267 aa, Homo sapiens; identical to SEQ ID NO: 27528
  Payload ID: 5429
  Gene Symbol: ECH1
  Gene Name: Enoyl-CoA hydratase 1, peroxisomal
  ENSP ID: ENSP00000489574
  MOD_RES (1)..(1): Any amino acid

SEQ ID NO: 27562 - protein, 723 aa, Homo sapiens
  Payload ID: 5430
  Gene Symbol: EHHADH
  Gene Name: enoyl-CoA, hydratase/3-hydroxyacyl CoA dehydrogenase
  Uniprot ID: Q08426
  ENSP ID: ENSP00000231887
MAEYTRLHNALALIRLRNPPVNAISTTLLRDIKEGLQKAVIDHTIKAIVICGAEGKFSAGADIRGFSAPRTFGLTLGHVVDEIQRNEKPVVAAIQGMAFGGGLELALGCHYRIAHAEAQVGLPEVTLGLLPGARGTQLLPRLTGVPAALDLITSGRRILADEALKLGILDKVVNSDPVEEAIRFAQRVSDQPLESRRLCNKPIQSLPNMDSIFSEALLKMRRQHPGCLAQEACVRAVQAAVQYPYEVGIKKEEELFLYLLQSGQARALQYAFFAERKANKWSTPSGASWKTASARPVSSVGVVGLGTMGRGIVISFARARIPVIAVDSDKNQLATANKMITSVLEKEASKMQQSGHPWSGPKPRLTSSVKELGGVDLVIEAVFEEMSLKKQVFAELSAVCKPEAFLCTNTSALDVDEIASSTDRPHLVIGTHFFSPAHVMKLLEVIPSQYSSPTTIATVMNLSKKIKKIGVVVGNCFGFVGNRMLNPYYNQAYFLLEEGSKPEEVDQVLEEFGFKMGPFRVSDLAGLDVGWKSRKGQGLTGPTLLPGTPARKRGNRRYCPIPDVLCELGRFGQKTGKGWYQYDKPLGRIHKPDPWLSKFLSRYRKTHHIEPRTISQDEILERCLYSLINEAFRILGEGIAASPEHIDVVYLHGYGWPRHKGGPMFYASTVGLPTVLEKLQKYYRQNPDIPQLEPSDYLKKLASQGNPPLKEWQSLAGSPSSKL

SEQ ID NO: 27563 - protein, 627 aa, Homo sapiens
  Payload ID: 5430
  Gene Symbol: EHHADH
  Gene Name: enoyl-CoA, hydratase/3-hydroxyacyl CoA dehydrogenase
  Uniprot ID: Q08426
  ENSP ID: ENSP00000387746
MAFGGGLELALGCHYRIAHAEAQVGLPEVTLGLLPGARGTQLLPRLTGVPAALDLITSGRRILADEALKLGILDKVVNSDPVEEAIRFAQRVSDQPLESRRLCNKPIQSLPNMDSIFSEALLKMRRQHPGCLAQEACVRAVQAAVQYPYEVGIKKEEELFLYLLQSGQARALQYAFFAERKANKWSTPSGASWKTASARPVSSVGVVGLGTMGRGIVISFARARIPVIAVDSDKNQLATANKMITSVLEKEASKMQQSGHPWSGPKPRLTSSVKELGGVDLVIEAVFEEMSLKKQVFAELSAVCKPEAFLCTNTSALDVDEIASSTDRPHLVIGTHFFSPAHVMKLLEVIPSQYSSPTTIATVMNLSKKIKKIGVVVGNCFGFVGNRMLNPYYNQAYFLLEEGSKPEEVDQVLEEFGFKMGPFRVSDLAGLDVGWKSRKGQGLTGPTLLPGTPARKRGNRRYCPIPDVLCELGRFGQKTGKGWYQYDKPLGRIHKPDPWLSKFLSRYRKTHHIEPRTISQDEILERCLYSLINEAFRILGEGIAASPEHIDVVYLHGYGWPRHKGGPMFYASTVGLPTVLEKLQKYYRQNPDIPQLEPSDYLKKLASQGNPPLKEWQSLAGSPSSKL

SEQ ID NO: 27564 - protein, 76 aa, Homo sapiens
  Payload ID: 5430
  Gene Symbol: EHHADH
  Gene Name: enoyl-CoA, hydratase/3-hydroxyacyl CoA dehydrogenase
  ENSP ID: ENSP00000396798
MAEYTRLHNALALIRLRNPPVNAISTTLLRDIKEGLQKAVIDHTIKAIVICGAEGKFSAGNSSLTLSHHLWNPATD

SEQ ID NO: 27565 - protein, 607 aa, Homo sapiens
  Payload ID: 5431
  Gene Symbol: ENTHD1
  Gene Name: ENTH domain containing 1
  Uniprot ID: Q8IYW4
  ENSP ID: ENSP00000317431
MAFRRQVKNFVKNYSDAEIKVREATSNDPWGPSSSLMLDISDLTFNTISLSEIMNMLWHRLNDHGKNWRHVYKSLTLMDYLIKNGSKKVIQHCREGFCNLQTLKDFQHIDEAGKDQGYYIREKSKQVITLLMDEPLLCKEREVACRTRQRTSHSILFSKRQLGSSNSLTACTSAPTPDISASEKKYKLPKFGRLHNKRNVCKAGLKQEHCQDVHLPTETMLSQETLPLKIHGWKSTEDLMTFLDDDPELPLLATPPSIVSPITCLSEAEEVCNLSGADAVPTLSENSPSGQRDVSLDKRSDGIFTNTVTENLLETPLEKQSAAEGLKTLTILPACWSSKEEFISPDLRVSKSDSTFHNQASVETLCLSPSFKIFDRVKEIVINKAYQKPAQSSIQMDDKILKTTTRVSTASEGASSFSPLSMSSPDLASPEKSAHLLSPILAGPSFWTLSHQQLSSTSFKDEDKTAKLHHSFASRGPVSSDVEENDSLNLLGILPNNSDSAKKNISHISSSHWGEFSTQNVDQFIPLSCSGFQSTKDFPQEPEAKNSISVLLREVKRAIARLHEDLSTVIQELNVINNILMSMSLNSSQISQSSQVPQSSEGSSDQI

SEQ ID NO: 27566 - protein, 525 aa, Homo sapiens
  Payload ID: 5432
  Gene Symbol: ENTHD2
  Gene Name: ENTH domain containing 2
  Uniprot ID: Q96N21
  ENSP ID: ENSP00000300714
MAAAPPLRDRLSFLHRLPILLKGTSDDDVPCPGYLFEEIAKISHESPGSSQCLLEYLLSRLHSSSGHGKLKVLKILLYLCSHGSSFFLLILKRNSAFIQEAAAFAGPPDPLHGNSLYQKVRAAAQDLGSTLFSDTVLPLAPSQPLGTPPATGMGSQARPHSTLQGFGYSKEHGRTAVRHQPGQAGGGWDELDSGPSSQNSSQNSDLSRVSDSGSHSGSDSHSGASREPGDLAERVEVVALSDCQQELSLVRTVTRGPRAFLSREEAQHFIKACGLLNCEAVLQLLTCHLRGTSECTQLRALCAIASLGSSDLLPQEHILLRTRPWLQELSMGSPGPVTNKATKILRHFEASCGQLSPARGTSAEPGPTAALPGPSDLLTDAVPLPGSQVFLQPLSSTPVSSRSPAPSSGMPSSPVPTPPPDASPIPAPGDPSEAEARLAESRRWRPERIPGGTDSPKRGPSSCAWSRDSLFAGMELVACPRLVGAGAAAGESCPDAPRAPQTSSQRTAAKEPPGSEPSAFAFLNA

SEQ ID NO: 27567 - protein, 52 aa, Homo sapiens
  Payload ID: 5432
  Gene Symbol: ENTHD2
  Gene Name: ENTH domain containing 2
  ENSP ID: ENSP00000460582
  MOD_RES (1)..(1): Any amino acid
XLSDCQQELSLVRTVTRGPRAFLSREEAQHFIKACPLCAGVDCSTVRPCCSC

SEQ ID NO: 27568 - protein, 183 aa, Homo sapiens
  Payload ID: 5432
  Gene Symbol: ENTHD2
  Gene Name: ENTH domain containing 2
  ENSP ID: ENSP00000460661
MAAAPPLRDRLSFLHRVSEGGPPGPRSHGSSRAPHSPDSPRAGAIDLASPRRVAAPGPFARADAPELPARRAVPGPSKPGLPSRTRRAQGRWAQPDPGGTNRPRPAFSGLRREGRSGGPGGRGAAVSVLLAPRWAGSPPSSLTVAFQRTPVLERHPWVAENTDVSKGQRRTHHSPDSPEGDVR

SEQ ID NO: 27569 - protein, 97 aa, Homo sapiens
  Payload ID: 5432
  Gene Symbol: ENTHD2
  Gene Name: ENTH domain containing 2
  ENSP ID: ENSP00000461294
  MOD_RES (1)..(1): Any amino acid
XDRLSFLHRLLLAPSPAPTPLSCPPAAPSRGLPSRAFQAGPAERKGDGHSQTLGERTGLGQHSVASDGREGAADPVDVEPLCPCCWRPGGLAARRPP

SEQ ID NO: 27570 - protein, 113 aa, Homo sapiens
  Payload ID: 5432
  Gene Symbol: ENTHD2
  Gene Name: ENTH domain containing 2
  ENSP ID: ENSP00000461490
MVGALVPFQLPILLKGTSDDDVPCPGYLFEEIAKISHESPGSSQCLLEYLLSRLHSSSGHGKLKVLKILLYLCSHGSSFFLLILKRNSAFIQEAAAFAGPPDPLHGNSLYQKV

SEQ ID NO: 27571 - protein, 2033 aa, Homo sapiens
  Payload ID: 5433
  Gene Symbol: EVPL
  Gene Name: envoplakin
  Uniprot ID: Q92817
  ENSP ID: ENSP00000301607
MFKGLSKGSQGKGSPKGSPAKGSPKGSPSRHSRAATQELALLISRMQANADQVERDILETQKRLQQDRLNSEQSQALQHQQETGRSLKEAEVLLKDLFLDVDKARRLKHPQAEEIEKDIKQLHERVTQECAEYRALYEKMVLPPDVGPRVDWARVLEQKQKQVCAGQYGPGMAELEQQIAEHNILQKEIDAYGQQLRSLVGPDAATIRSQYRDLLKAASWRGQSLGSLYTHLQGCTRQLSALAEQQRRILQQDWSDLMADPAGVRREYEHFKQHELLSQEQSVNQLEDDGERMVELRHPAVGPIQAHQEALKMEWQNFLNLCICQETQLQHVEDYRRFQEEADSVSQTLAKLNSNLDAKYSPAPGGPPGAPTELLQQLEAEEKRLAVTERATGDLQRRSRDVAPLPQRRNPPQQPLHVDSICDWDSGEVQLLQGERYKLVDNTDPHAWVVQGPGGETKRAPAACFCIPAPDPDAVARASRLASELQALKQKLATVQSRLKASAVESLRPSQQAPSGSDLANPQAQKLLTQMTRLDGDLGQIERQVLAWARAPLSRPTPLEDLEGRIHSHEGTAQRLQSLGTEKETAQKECEAFLSTRPVGPAALQLPVALNSVKNKFSDVQVLCSLYGEKAKAALDLERQIQDADRVIRGFEATLVQEAPIPAEPGALQERVSELQRQRRELLEQQTCVLRLHRALKASEHACAALQNNFQEFCQDLPRQQRQVRALTDRYHAVGDQLDLREKVVQDAALTYQQFKNCKDNLSSWLEHLPRSQVRPSDGPSQIAYKLQAQKRLTQEIQSRERDRATASHLSQALQAALQDYELQADTYRCSLEPTLAVSAPKRPRVAPLQESIQAQEKNLAKAYTEVAAAQQQLLQQLEFARKMLEKKELSEDIRRTHDAKQGSESPAQAGRESEALKAQLEEERKRVARVQHELEAQRSQLLQLRTQRPLERLEEKEVVEFYRDPQLEGSLSRVKAQVEEEGKRRAGLQADLEVAAQKVVQLESKRKTMQPHLLTKEVTQVERDPGLDSQAAQLRIQIQQLRGEDAVISARLEGLKKELLALEKREVDVKEKVVVKEVVKVEKNLEMVKAAQALRLQMEEDAARRKQAEEAVAKLQARIEDLERAISSVEPKVIVKEVKKVEQDPGLLQESSRLRSLLEEERTKNATLARELSDLHSKYSVVEKQRPKVQLQERVHEIFQVDPETEQEITRLKAKLQEMAGKRSGVEKEVEKLLPDLEVLRAQKPTVEYKEVTQEVVRHERSPEVLREIDRLKAQLNELVNSHGRSQEQLIRLQGERDEWRRERAKVETKTVSKEVVRHEKDPVLEKEAERLRQEVREAAQKRRAAEDAVYELQSKRLLLERRKPEEKVVVQEVVVTQKDPKLREEHSRLSGSLDEEVGRRRQLELEVQQLRAGVEEQEGLLSFQEDRSKKLAVERELRQLTLRIQELEKRPPTVQEKIIMEEVVKLEKDPDLEKSTEALRWDLDQEKTQVTELNRECKNLQVQIDVLQKAKSQEKTIYKEVIRVQKDRVLEDERARVWEMLNRERTARQAREEEARRLRERIDRAETLGRTWSREESELQRARDQADQECGRLQQELRALERQKQQQTLQLQEESKLLSQKTESERQKAAQRGQELSRLEAAILREKDQIYEKERTLRDLHAKVSREELSQETQTRETNLSTKISILEPETGKDMSPYEAYKRGIIDRGQYLQLQELECDWEEVTTSGPCGEESVLLDRKSGKQYSIEAALRCRRISKEEYHLYKDGHLPISEFALLVAGETKPSSSLSIGSIISKSPLASPAPQSTSFFSPSFSLGLGDDSFPIAGIYDTTTDNKCSIKTAVAKNMLDPITGQKLLEAQAATGGIVDLLSRERYSVHKAMERGLIENTSTQRLLNAQKAFTGIEDPVTKKRLSVGEAVQKGWMPRESVLPHLQVQHLTGGLIDPKRTGRIPIQQALLSGMISEELAQLLQDESSYEKDLTDPISKERLSYKEAMGRCRKDPLSGLLLLPAALEGYRCYRSASPTVPRSLR

SEQ ID NO: 27572 - protein, 2055 aa, Homo sapiens
  Payload ID: 5433
  Gene Symbol: EVPL
  Gene Name: envoplakin
  ENSP ID: ENSP00000465630
MFKGLSKGSQGKGSPKGSPAKGSPKGSPSRHSRAATQELALLISRMQANADQVERDILETQKRLQQDRLNSEQSQALQHQQETGRSLKEAEVLLKDLFLDVDKARRLKHPQAEEIEKDIKQLHERVTQECAEYRALYEKMVLPPDVGPRVDWARVLEQKQKQVCAGQYGPGMAELEQQIAEHNILQKEIDAYGQQLRSLVGPDAATIRSQYRDLLKAASWRGQSLGSLYTHLQGCTRQLSALAEQQRRILQQDWSDLMADPAGVRREYEHFKQHELLSQEQSVNQLEDDGERMVELRHPAVGPIQAHQEALKMEWQNFLNLCICQETQLQHVEDYRRFQEEADSVSQTLAKLNSNLDAKYSPAPGGPPGAPTELLQQLEAEEKRLAVTERATGDLQRRSRDVAPLPQRRNPPQQPLHVDSICDWDSGEVQLLQGERYKLVDNTDPHAWVVQGPGGETKRAPAACFCIPAPDPDAVARASRLASELQALKQKLATVQSRLKASAVESLRPSQQGTQGGPGRGGCGARRSRFRLPTAPSGSDLANPQAQKLLTQMTRLDGDLGQIERQVLAWARAPLSRPTPLEDLEGRIHSHEGTAQRLQSLGTEKETAQKECEAFLSTRPVGPAALQLPVALNSVKNKFSDVQVLCSLYGEKAKAALDLERQIQDADRVIRGFEATLVQEAPIPAEPGALQERVSELQRQRRELLEQQTCVLRLHRALKASEHACAALQNNFQEFCQDLPRQQRQVRALTDRYHAVGDQLDLREKVVQDAALTYQQFKNCKDNLSSWLEHLPRSQVRPSDGPSQIAYKLQAQKRLTQEIQSRERDRATASHLSQALQAALQDYELQADTYRCSLEPTLAVSAPKRPRVAPLQESIQAQEKNLAKAYTEVAAAQQQLLQQLEFARKMLEKKELSEDIRRTHDAKQGSESPAQAGRESEALKAQLEEERKRVARVQHELEAQRSQLLQLRTQRPLERLEEKEVVEFYRDPQLEGSLSRVKAQVEEEGKRRAGLQADLEVAAQKVVQLESKRKTMQPHLLTKEVTQVERDPGLDSQAAQLRIQIQQLRGEDAVISARLEGLKKELLALEKREVDVKEKVVVKEVVKVEKNLEMVKAAQALRLQMEEDAARRKQAEEAVAKLQARIEDLERAISSVEPKVIVKEVKKVEQDPGLLQESSRLRSLLEEERTKNATLARELSDLHSKYSVVEKQRPKVQLQERVHEIFQVDPETEQEITRLKAKLQEMAGKRSGVEKEVEKLLPDLEVLRAQKPTVEYKEVTQEVVRHERSPEVLREIDRLKAQLNELVNSHGRSQEQLIRLQGERDEWRRERAKVETKTVSKEVVRHEKDPVLEKEAERLRQEVREAAQKRRAAEDAVYELQSKRLLLERRKPEEKVVVQEVVVTQKDPKLREEHSRLSGSLDEEVGRRRQLELEVQQLRAGVEEQEGLLSFQEDRSKKLAVERELRQLTLRIQELEKRPPTVQEKIIMEEVVKLEKDPDLEKSTEALRWDLDQEKTQVTELNRECKNLQVQIDVLQKAKSQEKTIYKEVIRVQKDRVLEDERARVWEMLNRERTARQAREEEARRLRERIDRAETLGRTWSREESELQRARDQADQECGRLQQELRALERQKQQQTLQLQEESKLLSQKTESERQKAAQRGQELSRLEAAILREKDQIYEKERTLRDLHAKVSREELSQETQTRETNLSTKISILEPETGKDMSPYEAYKRGIIDRGQYLQLQELECDWEEVTTSGPCGEESVLLDRKSGKQYSIEAALRCRRISKEEYHLYKDGHLPISEFALLVAGETKPSSSLSIGSIISKSPLASPAPQSTSFFSPSFSLGLGDDSFPIAGIYDTTTDNKCSIKTAVAKNMLDPITGQKLLEAQAATGGIVDLLSRERYSVHKAMERGLIENTSTQRLLNAQKAFTGIEDPVTKKRLSVGEAVQKGWMPRESVLPHLQVQHLTGGLIDPKRTGRIPIQQALLSGMISEELAQLLQDESSYEKDLTDPISKERLSYKEAMGRCRKDPLSGLLLLPAALEGYRCYRSASPTVPRSLR

SEQ ID NO: 27573 - protein, 112 aa, Homo sapiens
  Payload ID: 5433
  Gene Symbol: EVPL
  Gene Name: envoplakin
  ENSP ID: ENSP00000467717
QKGWMPRESVLPHLQVQHLTGGLIDPKRTGRIPIQQALLSGMISEELAQLLQDESSYEKDLTDPISKERLSYKEAMGRCRKDPLSGLLLLPAALEGYRCYRSASPTVPRSLR

SEQ ID NO: 27574 - protein, 301 aa, Homo sapiens
  Payload ID: 5434
  Gene Symbol: EVPLL
  Gene Name: envoplakin-like
  Uniprot ID: A8MZ36
  ENSP ID: ENSP00000382086
MQASADQVERDILETQKRLQQDRLNSEQSQALQHQQETGSSLKEAEVLLKDLFLDVDKARRLKHPQAEETEKDIEQLHERVTQECAEYCALYEKMVLPPRRGIQGRLGTRAGAETEAGLRRPVWAGHGGAGGTDRGAQHRAEGDQRPRRAAAEPGGAGCRHHPEPIPRPTEGGVVARAEPGQPVHALQGCTWQLSALAEQQRRILQQDWSDLMADPAGVRREYEHFKQHELLSQEQSVNQLEEDGKRMVELRHPAVGPIQAHQEALKMEWQNFLNLCICQETQLQHVEDYSRILCPSSSPH

SEQ ID NO: 27575 - protein, 686 aa, Homo sapiens
  Payload ID: 5435
  Gene Symbol: EOMES
  Gene Name: eomesodermin
  Uniprot ID: O95936
  ENSP ID: ENSP00000295743
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSERYYLQSPGPQGSELAAPCSLFPYQAAAGAPHGPVYPAPNGARYPYGSMLPPGGFPAAVCPPGRAQFGPGAGAGSGAGGSSGGGGGPGTYQYSQGAPLYGPYPGAAAAGSCGGLGGLGVPGSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 27576 - protein, 705 aa, Homo sapiens
  Payload ID: 5435
  Gene Symbol: EOMES
  Gene Name: eomesodermin
  Uniprot ID: O95936
  ENSP ID: ENSP00000388620
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSERYYLQSPGPQGSELAAPCSLFPYQAAAGAPHGPVYPAPNGARYPYGSMLPPGGFPAAVCPPGRAQFGPGAGAGSGAGGSSGGGGGPGTYQYSQGAPLYGPYPGAAAAGSCGGLGGLGVPGSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSMYTASENDRLTPSPTDSPRSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 27577 - protein, 410 aa, Homo sapiens
  Payload ID: 5435
  Gene Symbol: EOMES
  Gene Name: eomesodermin
  Uniprot ID: O95936
  ENSP ID: ENSP00000487112
MFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSMYTASENDRLTPSPTDSPRSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 27578 - protein, 715 aa, Homo sapiens
  Payload ID: 5436
  Gene Symbol: EPX
  Gene Name: eosinophil peroxidase
  Uniprot ID: P11678
  ENSP ID: ENSP00000225371
MHLLPALAGVLATLVLAQPCEGTDPASPGAVETSVLRDCIAEAKLLVDAAYNWTQKSIKQRLRSGSASPMDLLSYFKQPVAATRTVVRAADYMHVALGLLEEKLQPQRSGPFNVTDVLTEPQLRLLSQASGCALRDQAERCSDKYRTITGRCNNKRRPLLGASNQALARWLPAEYEDGLSLPFGWTPSRRRNGFLLPLVRAVSNQIVRFPNERLTSDRGRALMFMQWGQFIDHDLDFSPESPARVAFTAGVDCERTCAQLPPCFPIKIPPNDPRIKNQRDCIPFFRSAPSCPQNKNRVRNQINALTSFVDASMVYGSEVSLSLRLRNRTNYLGLLAINQRFQDNGRALLPFDNLHDDPCLLTNRSARIPCFLAGDTRSTETPKLAAMHTLFMREHNRLATELRRLNPRWNGDKLYNEARKIMGAMVQIITYRDFLPLVLGKARARRTLGHYRGYCSNVDPRVANVFTLAFRFGHTMLQPFMFRLDSQYRASAPNSHVPLSSAFFASWRIVYEGGIDPILRGLMATPAKLNRQDAMLVDELRDRLFRQVRRIGLDLAALNMQRSRDHGLPGYNAWRRFCGLSQPRNLAQLSRVLKNQDLARKFLNLYGTPDNIDIWIGAIAEPLLPGARVGPLLACLFENQFRRARDGDRFWWQKRGVFTKRQRKALSRISLSRIICDNTGITTVSRDIFRANIYPRGFVNCSRIPRLNLSAWRGT

SEQ ID NO: 27579 - protein, 187 aa, Homo sapiens
  Payload ID: 5437
  Gene Symbol: EID1
  Gene Name: EP300 interacting inhibitor of differentiation 1
  Uniprot ID: Q9Y6B2
  ENSP ID: ENSP00000431162
MSEMAELSELYEESSDLQMDVMPGEGDLPQMEVGSGSRELSLRPSRSGAQQLEEEGPMEEEEAQPMAAPEGKRSLANGPNAGEQPGQVAGADFESEDEGEEFDDWEDDYDYPEEEQLSGAGYRVSAALEEADKMFLRTREPALDGGFQMHYEKTPFDQLAFIEELFSLMVVNRLTEELGCDEIIDRE

SEQ ID NO: 27580 - protein, 165 aa, Homo sapiens
  Payload ID: 5437
  Gene Symbol: EID1
  Gene Name: EP300 interacting inhibitor of differentiation 1
  ENSP ID: ENSP00000453886
MSEMAELSELYEESSDLQMDVMPGEGDLPQMEEGPMEEEEAQPMAAPEGKRSLANGPNAGEQPGQVAGADFESEDEGEEFDDWEDDYDYPEEEQLSGAGYRVSAALEEADKMFLRTREPALDGGFQMHYEKTPFDQLAFIEELFSLMVVNRLTEELGCDEIIDRE

SEQ ID NO: 27581 - protein, 236 aa, Homo sapiens
  Payload ID: 5438
  Gene Symbol: EID2
  Gene Name: EP300 interacting inhibitor of differentiation 2
  Uniprot ID: Q8N6I1
  ENSP ID: ENSP00000375073
MSKLPADSSVPQTGAANGDRDVPQAEVGRGRREPAPAQPEEAGEGAMAAARGGPVPAAREGRMAAARAAPAAAARGAPVAAAALARAAAAGRESPAAAAAREARMAEVARLLGEPVDEEGPEGRPRSRHGNGGLAALPYLRLRHPLSVLGINYQQFLRHYLENYPIAPGRIQELEERRRRFVEACRAREAAFDAEYQRNPHRVDLDILTFTIALTASEVINPLIEELGCDKFINRE

SEQ ID NO: 27582 - protein, 161 aa, Homo sapiens
  Payload ID: 5439
  Gene Symbol: EID2B
  Gene Name: EP300 interacting inhibitor of differentiation 2B
  Uniprot ID: Q96D98
  ENSP ID: ENSP00000317564
MAEPTGLLEMSELPGDSSVPQVGTASGVSDVLRGAVGGGVRVQEAREGPVAEAARSMARMPGPVPGPIPSSVPGLASAPDPHQQLAFLEINRQLLFREYLDGSSMIPVRLLRDFEERRRLFVEGCKAREAAFDADPPQMDFAAVAFTVALTASEALSPLAD

SEQ ID NO: 27583 - protein, 333 aa, Homo sapiens
  Payload ID: 5440
  Gene Symbol: EID3
  Gene Name: EP300 interacting inhibitor of differentiation 3
  Uniprot ID: Q8N140
  ENSP ID: ENSP00000435619
MKMDVSVRAAGCSDDLSSGEADVDPKLLELTADEEKCRSIRRQYRQLMYCVRQNREDIVSSANNSLTEALEEANVLFDGVSRTREAALDARFLVMASDLGKEKAKQLNSDMNFFNQLAFCDFLFLFVGLNWMEGDPDKLSDCDDSIALSFWKAIEKEATSWMVKAETFHFVFGSFKLERSAPKPRLEHQKKVRKMEENGNMPTKLQKLDLSSYPEATEKNVERILGLLQTYFRKYPDTPVSYFEFVIDPNSFSRTVENIFYVSFIVRDGFARIRLDEDRLPILEPMNVNQMGEGNDSSCHGRKQGVISLTLQEWKNIVAAFEISEAMITYSSY

SEQ ID NO: 27584 - protein, 430 aa, Homo sapiens
  Payload ID: 5441
  Gene Symbol: EP400NL
  Gene Name: EP400 N-terminal like
  Uniprot ID: Q6ZTU2
  ENSP ID: ENSP00000328997
MQHVSSSQSSQRHVQWPGACPGAGEEQPACSQPSLPLTLPSPSHQLQQLMQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHHQEMQALKEVFKEYLIELFFLQHFQGNMMDFLAFKERLYGPLQAYLRQNDLDIEEEEEEHFEVINDEVKVVARKHGQPGTPVAIATQLPPRTSAAFPAQQQPLQPLAPTTVLSVSADWNALLQRPNKYIWGLQYLEM

SEQ ID NO: 27585 - protein, 419 aa, Homo sapiens [sequence omitted]

SEQ ID NO: 27586 - protein, 356 aa, Homo sapiens
  Payload ID: 5441
  Gene Symbol: EP400NL
  Gene Name: EP400 N-terminal like
  Uniprot ID: Q6ZTU2
  ENSP ID: ENSP00000376163
MQHVSSSQSSQRHVQWPGACPGAGEEQPACSQPSLPLTLPSPSHQLQQLMDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHHQEMQALKEVFKEYLIELFFLQHFQGNMMDFLAFKERLYGPLQAYLRQNDLDIEEEEEEHFEVINDEVKVVARKHGQPGTPVAIATQLPPRTSAAFPAQQQPLQVLSDGSTVQLPRLSSLGFEDSMC

SEQ ID NO: 27587 - protein, 217 aa, Homo sapiens
  Payload ID: 5441
  Gene Symbol: EP400NL
  Gene Name: EP400 N-terminal like
  ENSP ID: ENSP00000385626
MQHVSSSQSSQRHVQWPGACPGAGEEQPACSQPSLPLTLPSPSHQLQQLMDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPE

SEQ ID NO: 27588 - protein, 488 aa, Homo sapiens
  Payload ID: 5441
  Gene Symbol: EP400NL
  Gene Name: EP400 N-terminal like
  Uniprot ID: Q6ZTU2
  ENSP ID: ENSP00000396499
MQHVSSSQSSQRHVQWPGACPGAGEEQPACSQPSLPLTLPSPSHQLQQLMVRGGPAGGQNMNVDLQGVGPGLQGSPQVTLAPLPLPSPTSPGFQFSAQPRRFEHGSPSYIQVTSPLSQQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHHQEMQALKEVFKEYLIELFFLQHFQGNMMDFLAFKERLYGPLQAYLRQNDLDIEEEEEEHFEVINDEVKVVARKHGQPGTPVAIATQLPPRTSAAFPAQQQPLQQIHMGTPVPGDVNSIKMEASKRQ

SEQ ID NO: 27589 - protein, 223 aa, Homo sapiens
  Payload ID: 5441
  Gene Symbol: EP400NL
  Gene Name: EP400 N-terminal like
  ENSP ID: ENSP00000402806
MQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLP

SEQ ID NO: 27590 - protein, 356 aa, Homo sapiens; identical to SEQ ID NO: 27586
  Payload ID: 5441
  Gene Symbol: EP400NL
  Gene Name: EP400 N-terminal like
  Uniprot ID: Q6ZTU2
  ENSP ID: ENSP00000404338

SEQ ID NO: 27591 - protein, 156 aa, Homo sapiens
  Payload ID: 5441
  Gene Symbol: EP400NL
  Gene Name: EP400 N-terminal like
  ENSP ID: ENSP00000441814
MQHVSSSQSSQRHVQWPGACPGAGEEQPACSQPSLPLTLPSPSHQLQQLMVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHH

SEQ ID NO: 27592 - protein, 224 aa, Homo sapiens
  Payload ID: 5442
  Gene Symbol: EPDR1
  Gene Name: ependymin related 1
  Uniprot ID: Q9UM22
  ENSP ID: ENSP00000199448
MPGRAPLRTVPGALGAWLLGGLWAWTLCGLCSLGAVGAPRPCQAPQQWEGRQVMYQQSSGRNSRALLSYDGLNQRVRVLDERKALIPCKRLFEYILLYKDGVMFQIDQATKQCSKMTLTQPWDPLDIPQNSTFEDQYSIGGPQEQITVQEWSDRKSARSYETWIGIYTVKDCYPVQETFTINYSVILSTRFFDIQLGIKDPSVFTPPSTCQMAQLEKMSEDCSW

SEQ ID NO: 27593 - protein, 90 aa, Homo sapiens
  Payload ID: 5442
  Gene Symbol: EPDR1
  Gene Name: ependymin related 1
  Uniprot ID: Q9UM22
  ENSP ID: ENSP00000409211
MPGRAPLRTVPGALGAWLLGGLWAWTLCGLCSLGAVGAPRPCQAPQQWEGRQVMYQQSSGRNSRALLSYDGLNQRVRVLDERKALIPCKR

SEQ ID NO: 27594 - protein, 163 aa, Homo sapiens
  Payload ID: 5442
  Gene Symbol: EPDR1
  Gene Name: ependymin related 1
  Uniprot ID: Q9UM22
  ENSP ID: ENSP00000413359
MVRDWEGRCAHRGRPAGGGLSNTQRGGGRLFEYILLYKDGVMFQIDQATKQCSKMTLTQPWDPLDIPQNSTFEDQYSIGGPQEQITVQEWSDRKSARSYETWIGIYTVKDCYPVQETFTINYSVILSTRFFDIQLGIKDPSVFTPPSTCQMAQLEKMSEDCSW

SEQ ID NO: 27595 - protein, 122 aa, Homo sapiens
  Payload ID: 5442
  Gene Symbol: EPDR1
  Gene Name: ependymin related 1
  ENSP ID: ENSP00000425858
MFQIDQATKQCSKMTLTQPWDPLDIPQNSTFEDQYSIGGPQEQITVQEWSDRKSARSYETWIGIYTVKDCYPVQETFTINYSVILSTRFFDIQLGIKDPSVFTPPSTCQMAQLEKMSEDCSW

SEQ ID NO: 27596 - protein, 976 aa, Homo sapiens
  Payload ID: 5443
  Gene Symbol: EPHA1
  Gene Name: EPH receptor A1
  Uniprot ID: P21709
  ENSP ID: ENSP00000275815
MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLVSGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRMTLRLPSLSGSDGIPYRTVSEWLESIRMKRYILHFHSAGLDTMECVLELTAEDLTQMGITLPGHQKRILCSIQGFKD

SEQ ID NO: 27597 - protein, 295 aa, Homo sapiens
  Payload ID: 5444
  Gene Symbol: EPHA10
  Gene Name: EPH receptor A10
  Uniprot ID: Q5JZY3
  ENSP ID: ENSP00000316395
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEGIQLAGGRGVGV

SEQ ID NO: 27598 - protein, 1008 aa, Homo sapiens
  Payload ID: 5444
  Gene Symbol: EPHA10
  Gene Name: EPH receptor A10
  Uniprot ID: Q5JZY3
  ENSP ID: ENSP00000362139
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEACPPGFYKVSPRRPLCSPCPEHSRALENASTFCVCQDSYARSPTDPPSASCTRPPSAPRDLQYSLSRSPLVLRLRWLPPADSGGRSDVTYSLLCLRCGREGPAGACEPCGPRVAFLPRQAGLRERAATLLHLRPGARYTVRVAALNGVSGPAAAAGTTYAQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGERPRFSQIHSILSKMVQDPEPPKCALTTCPRPPTPLADRAFSTFPSFGSVGAWLEALDLCRYKDSFAAAGYGSLEAVAEMTAQDLVSLGISLAEHREALLSGISALQARVLQLQGQGVQV

SEQ ID NO: 27599 - protein, 1014 aa, Homo sapiens
  Payload ID: 5444
  Gene Symbol: EPHA10
  Gene Name: EPH receptor A10
  ENSP ID: ENSP00000397746
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEACPPGFYKVSPRRPLCSPCPEHSRALENASTFCVCQDSYARSPTDPPSASCTRPPSAPRDLQYSLSRSPLVLRLRWLPPADSGGRSDVTYSLLCLRCGREGPAGACEPCGPRVAFLPRQAGLRERAATLLHLRPGARYTVRVAALNGVSGPAAAAGTTYAQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGERPRFSQIHSILSKMVQDPEPPKCALTTCPRPPTPLADRAFSTFPSFGSVGAWLEALDLCRYKDSFAAAGYGSLEAVAEMTAQDLVSLGISLAEHREALLSGISALQARVLQLQGQGVQVIIKTCL

SEQ ID NO: 27600 - protein, 392 aa, Homo sapiens
  Payload ID: 5444
  Gene Symbol: EPHA10
  Gene Name: EPH receptor A10
  ENSP ID: ENSP00000431389
EQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGLPPH

SEQ ID NO: 27601 - protein, 218 aa, Homo sapiens
  Payload ID: 5444
  Gene Symbol: EPHA10
  Gene Name: EPH receptor A10
  ENSP ID: ENSP00000432693
AQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGLETSPH

SEQ ID NO: 27602 - protein, 92 aa, Homo sapiens
  Payload ID: 5444
  Gene Symbol: EPHA10
  Gene Name: EPH receptor A10
  ENSP ID: ENSP00000436288
  MOD_RES (1)..(1): Any amino acid
XHLRPGARYTVRVAALNGVSGPAAAAGTTYAQVTVSTGPGAPWEEDEIRRDRVEPQSVSLSWREPIPAGAPGANDTEYEIRYYEKDTCADFC

SEQ ID NO: 27603 - protein, 217 aa, Homo sapiens
  Payload ID: 5444
  Gene Symbol: EPHA10
  Gene Name: EPH receptor A10
  ENSP ID: ENSP00000436425
  MOD_RES (1)..(1): Any amino acid
XQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGLCSCLEALPPHQAHPPPRKSLACLIIGKRMAEGSVTLSWSSRAVWGAVLWLLAAPRSPGAARSRAYAEGQRLRLTEARLPGRGPHAGPV

SEQ ID NO: 27604 - protein, 155 aa, Homo sapiens
  Payload ID: 5444
  Gene Symbol: EPHA10
  Gene Name: EPH receptor A10
  ENSP ID: ENSP00000441822
MVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGLETSPH

SEQ ID NO: 27605 - protein, 976 aa, Homo sapiens
  Payload ID: 5445
  Gene Symbol: EPHA2
  Gene Name: EPH receptor A2
  Uniprot ID: P29317
  ENSP ID: ENSP00000351209
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 27606 - protein, 983 aa, Homo sapiens
  Payload ID: 5446
  Gene Symbol: EPHA3
  Gene Name: EPH receptor A3
  Uniprot ID: P29320
  ENSP ID: ENSP00000337451
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 27607 - protein, 539 aa, Homo sapiens
  Payload ID: 5446
  Gene Symbol: EPHA3
  Gene Name: EPH receptor A3
  Uniprot ID: P29320
  ENSP ID: ENSP00000399926
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDCMYYFNAV

SEQ ID NO: 27608 - protein, 918 aa, Homo sapiens
  Payload ID: 5446
  Gene Symbol: EPHA3
  Gene Name: EPH receptor A3
  ENSP ID: ENSP00000419190
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTVT

SEQ ID NO: 27609 - protein, 986 aa, Homo sapiens
  Payload ID: 5447
  Gene Symbol: EPHA4
  Gene Name: EPH receptor A4
  Uniprot ID: P54764
  ENSP ID: ENSP00000281821
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 27610 - protein, 949 aa, Homo sapiens
  Payload ID: 5447
  Gene Symbol: EPHA4
  Gene Name: EPH receptor A4
  ENSP ID: ENSP00000386276
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQE

SEQ ID NO: 27611 - protein, 986 aa, Homo sapiens; identical to SEQ ID NO: 27609
  Payload ID: 5447
  Gene Symbol: EPHA4
  Gene Name: EPH receptor A4
  Uniprot ID: P54764
  ENSP ID: ENSP00000386829

SEQ ID NO: 27612 - protein, 38 aa, Homo sapiens
  Payload ID: 5447
  Gene Symbol: EPHA4
  Gene Name: EPH receptor A4
  ENSP ID: ENSP00000391517
MAGIFYFALFSCLFGICDAVTGSRVYPANEVGGSEYHG

SEQ ID NO: 27613 - protein, 177 aa, Homo sapiens
  Payload ID: 5447
  Gene Symbol: EPHA4
  Gene Name: EPH receptor A4
  ENSP ID: ENSP00000395917
MAGIFYFALFSCLFGICDAVTGSRVYPANEGPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILE

SEQ ID NO: 27614 - protein, 188 aa, Homo sapiens
  Payload ID: 5447
  Gene Symbol: EPHA4
  Gene Name: EPH receptor A4
  ENSP ID: ENSP00000401405
  MOD_RES (1)..(1): Any amino acid
XFHGSLSSTHFTCKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKE

SEQ ID NO: 27615 - protein, 91 aa, Homo sapiens
  Payload ID: 5447
  Gene Symbol: EPHA4
  Gene Name: EPH receptor A4
  ENSP ID: ENSP00000404089
MAGIFYFALFSCLFGICDAVTGSRVYPANEVTLLDSRSVQGELGWIASPLEGGWEEVSIMDEKNTPIRTYQVCNVMEPSQNNWLRTDWITR

SEQ ID NO: 27616 - protein, 37 aa, Homo sapiens
  Payload ID: 5447
  Gene Symbol: EPHA4
  Gene Name: EPH receptor A4
  ENSP ID: ENSP00000408145
AYRKFTSASDVWSYGIVMWEVMSYGERPYWDMSNQDT

SEQ ID NO: 27617 - protein, 126 aa, Homo sapiens
  Payload ID: 5447
  Gene Symbol: EPHA4
  Gene Name: EPH receptor A4
  ENSP ID: ENSP00000410158
MDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAF

SEQ ID NO: 27618 - protein, 149 aa, Homo sapiens
  Payload ID: 5447
  Gene Symbol: EPHA4
  Gene Name: EPH receptor A4
  ENSP ID: ENSP00000444085
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIA

SEQ ID NO: 27619 - protein, 1037 aa, Homo sapiens
  Payload ID: 5448
  Gene Symbol: EPHA5
  Gene Name: EPH receptor A5
  Uniprot ID: P54756
  ENSP ID: ENSP00000273854
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFAASSDQSQIPVIAVSVTVGVILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 27620 - protein, 1015 aa, Homo sapiens
  Payload ID: 5448
  Gene Symbol: EPHA5
  Gene Name: EPH receptor A5
  Uniprot ID: P54756
  ENSP ID: ENSP00000346899
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFAASSDQSQIPVIAVSVTVGVILLAVVIGVLLSGRRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 27621 - protein, 874 aa, Homo sapiens
  Payload ID: 5448
  Gene Symbol: EPHA5
  Gene Name: EPH receptor A5
  ENSP ID: ENSP00000389208
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQAPSPVTNVKKGKIAKNSISLSWQEPDRPNGIILEYEIKYFEKDQETSYTIIKSKETTITAEGLKPASVYVFQIRARTAAGYGVFSRRFEFETTPVSVAASSDQSQIPVIAVSVTVGVILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 27622 - protein, 1004 aa, Homo sapiens
  Payload ID: 5448
  Gene Symbol: EPHA5
  Gene Name: EPH receptor A5
  ENSP ID: ENSP00000427638
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVSVAASSDQSQIPVIAVSVTVGVILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLE

SEQ ID NO: 27623 - protein, 1016 aa, Homo sapiens
  Payload ID: 5448
  Gene Symbol: EPHA5
  Gene Name: EPH receptor A5
  ENSP ID: ENSP00000478537
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVSVAASSDQSQIPVIAVSVTVGVILLAVVIGVLLSGRRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 27624 - protein, 1038 aa, Homo sapiens
  Payload ID: 5448
  Gene Symbol: EPHA5
  Gene Name: EPH receptor A5
  ENSP ID: ENSP00000480763
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVSVAASSDQSQIPVIAVSVTVGVILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 27625 - protein, 1130 aa, Homo sapiens
  Payload ID: 5449
  Gene Symbol: EPHA6
  Gene Name: EPH receptor A6
  ENSP ID: ENSP00000374323
MQFPSPPAARSSPAPQAASSSEAAAPATGQPGPSCPVPGTSRRGRPGTPPAGRVEEEEEEEEEDVDKDPHPTQNTCLRCRHFSLRERKREPRRTMGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHACRPGFYKAFAGNTKCSKCPPHSLTYMEATSVCQCEKGYFRAEKDPPSMACTRPPSAPRNVVFNINETALILEWSPPSDTGGRKDLTYSVICKKCGLDTSQCEDCGGGLRFIPRHTGLINNSVIVLDFVSHVNYTFEIEAMNGVSELSFSPKPFTAITVTTDQDAPSLIGVVRKDWASQNSIALSWQAPAFSNGAILDYEIKYYEKEHEQLTYSSTRSKAPSVIITGLKPATKYVFHIRVRTATGYSGYSQKFEFETGDETSDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTGGKIPIRWTAPEAIAYRKFSSASDAWSYGIVMWEVMSYGERPYWEMSNQDVILSIEEGYRLPAPMGCPASLHQLMLHCWQKERNHRPKFTDIVSFLDKLIRNPSALHTLVEDILVMPESPGEVPEYPLFVTVGDWLDSIKMGQYKNNFVAAGFTTFDLISRMSIDDIRRIGVILIGHQRRIVSSIQTLRLHMMHIQEKGFHV

SEQ ID NO: 27626 - protein, 373 aa, Homo sapiens
  Payload ID: 5449
  Gene Symbol: EPHA6
  Gene Name: EPH receptor A6
  ENSP ID: ENSP00000419470
MAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKSRPVMIVVEYMENGSLDSFLRKHDGHFTVIQLVGMLRGIASGMKYLSDMGYVHRDLAARNILVNSNLVCKVSDFGLSRVLEDDPEAAYTTTGGKIPIRWTAPEAIAYRKFSSASDAWSYGIVMWEVMSYGERPYWEMSNQDVILSIEEGYRLPAPMGCPASLHQLMLHCWQKERNHRPKFTDIVSFLDKLIRNPSALHTLVEDILVSNHESF

SEQ ID NO: 27627 - protein, 547 aa, Homo sapiens
  Payload ID: 5449
  Gene Symbol: EPHA6
  Gene Name: EPH receptor A6
  ENSP ID: ENSP00000420598
MQFPSPPAARSSPAPQAASSSEAAAPATGQPGPSCPVPGTSRRGRPGTPPAGRVEEEEEEEEEDVDKDPHPTQNTCLRCRHFSLRERKREPRRTMGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHACRPGFYKAFAGNTKCSKCPPHSLTYMEATSVCQCEKGYFRAEKDPPSMACTRPPSAPRNVVFNINETALILEWSPPSDTGGRKDLTYSVICKKCGLDTSQCEDCGGGLRFIPRHTGLINNSVIVLDFVSHVNYTFEIEAMNGVSELSFSPKPFTAITVTTDQDGKFHCCSLKTDP

SEQ ID NO: 27628 - protein, 208 aa, Homo sapiens
  Payload ID: 5449
  Gene Symbol: EPHA6
  Gene Name: EPH receptor A6
  ENSP ID: ENSP00000421260
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKKPLEMMTYILRAKGEAGFLKK

SEQ ID NO: 27629 - protein, 55 aa, Homo sapiens
  Payload ID: 5449
  Gene Symbol: EPHA6
  Gene Name: EPH receptor A6
  ENSP ID: ENSP00000421353
FVAAGFTTFDLISRMSIDDIRRIGVILIGHQRRIVSSIQTLRLHMMHIQEKGFHV

SEQ ID NO: 27630 - protein, 398 aa, Homo sapiens
  Payload ID: 5449
  Gene Symbol: EPHA6
  Gene Name: EPH receptor A6
  Uniprot ID: Q9UF33
  ENSP ID: ENSP00000421711
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTRPTNHNKEQSELVKEDGLESLCEQCESSSGYGTGLVLMWKRNRRAMGASGQTRKQCDKRDNPPTDLFQTLTLNLCYSA

SEQ ID NO: 27631 - protein, 334 aa, Homo sapiens
  Payload ID: 5449
  Gene Symbol: EPHA6
  Gene Name: EPH receptor A6
  Uniprot ID: Q9UF33
  ENSP ID: ENSP00000423950
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTDLFQTLTLNLCYSA

SEQ ID NO: 27632 - protein, 241 aa, Homo sapiens
  Payload ID: 5449
  Gene Symbol: EPHA6
  Gene Name: EPH receptor A6
  ENSP ID: ENSP00000424638
MAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRLYPKAEYNGKQCSRYSI

SEQ ID NO: 27633 - protein, 324 aa, Homo sapiens
  Payload ID: 5449
  Gene Symbol: EPHA6
  Gene Name: EPH receptor A6
  ENSP ID: ENSP00000425132
  MOD_RES (1)..(1): Any amino acid
XEEEEEEEDVDKDPHPTQNTCLRCRHFSLRERKREPRRTMGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHGASKGRCF

SEQ ID NO: 27634 - protein, 279 aa, Homo sapiens
  Payload ID: 5450
  Gene Symbol: EPHA7
  Gene Name: EPH receptor A7
  Uniprot ID: Q15375
  ENSP ID: ENSP00000358303
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCERK

SEQ ID NO: 27635 - protein, 998 aa, Homo sapiens
  Payload ID: 5450
  Gene Symbol: EPHA7
  Gene Name: EPH receptor A7
  Uniprot ID: Q15375
  ENSP ID: ENSP00000358309
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 27636 - protein, 1005 aa, Homo sapiens
  Payload ID: 5451
  Gene Symbol: EPHA8
  Gene Name: EPH receptor A8
  Uniprot ID: P29322
  ENSP ID: ENSP00000166244
MAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAAPSQVVVIRQERAGQTSVSLLWQEPEQPNGIILEYEIKYYEKDKEMQSYSTLKAVTTRATVSGLKPGTRYVFQVRARTSAGCGRFSQAMEVETGKPRPRYDTRTIVWICLTLITGLVVLLLLLICKKRHCGYSKAFQDSDEEKMHYQNGQAPPPVFLPLHHPPGKLPEPQFYAEPHTYEEPGRAGRSFTREIEASRIHIEKIIGSGDSGEVCYGRLRVPGQRDVPVAIKALKAGYTERQRRDFLSEASIMGQFDHPNIIRLEGVVTRGRLAMIVTEYMENGSLDTFLRTHDGQFTIMQLVGMLRGVGAGMRYLSDLGYVHRDLAARNVLVDSNLVCKVSDFGLSRVLEDDPDAAYTTTGGKIPIRWTAPEAIAFRTFSSASDVWSFGVVMWEVLAYGERPYWNMTNRDVISSVEEGYRLPAPMGCPHALHQLMLDCWHKDRAQRPRFSQIVSVLDALIRSPESLRATATVSRCPPPAFVRSCFDLRGGSGGGGGLTVGDWLDSIRMGRYRDHFAAGGYSSLGMVLRMNAQDVRALGITLMGHQKKILGSIQTMRAQLTSTQGPRRHL

SEQ ID NO: 27637 - protein, 495 aa, Homo sapiens
  Payload ID: 5451
  Gene Symbol: EPHA8
  Gene Name: EPH receptor A8
  Uniprot ID: P29322
  ENSP ID: ENSP00000363775
MAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAGRRRNSVPQRPGPPASPASDPSRDQSSAGDVLWAFRQVPLWPCAPHQDPELEALHCL

SEQ ID NO: 27638 - protein, 495 aa, Homo sapiens; identical to SEQ ID NO: 27637
  Payload ID: 5451
  Gene Symbol: EPHA8
  Gene Name: EPH receptor A8
  Uniprot ID: P29322
  ENSP ID: ENSP00000440274

SEQ ID NO: 27639 - protein, 984 aa, Homo sapiens
  Payload ID: 5452
  Gene Symbol: EPHB1
  Gene Name: EPH receptor B1
  Uniprot ID: P54762
  ENSP ID: ENSP00000381097
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 27640 - protein, 102 aa, Homo sapiens
  Payload ID: 5452
  Gene Symbol: EPHB1
  Gene Name: EPH receptor B1
  ENSP ID: ENSP00000417216
MDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATK

SEQ ID NO: 27641 - protein, 112 aa, Homo sapiens
  Payload ID: 5452
  Gene Symbol: EPHB1
  Gene Name: EPH receptor B1
  ENSP ID: ENSP00000417435
MDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPY

SEQ ID NO: 27642 - protein, 149 aa, Homo sapiens
  Payload ID: 5452
  Gene Symbol: EPHB1
  Gene Name: EPH receptor B1
  ENSP ID: ENSP00000418352
MDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRN

SEQ ID NO: 27643 - protein, 545 aa, Homo sapiens
  Payload ID: 5452
  Gene Symbol: EPHB1
  Gene Name: EPH receptor B1
  Uniprot ID: P54762
  ENSP ID: ENSP00000419574
MHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 27644 - protein, 42 aa, Homo sapiens
  Payload ID: 5452
  Gene Symbol: EPHB1
  Gene Name: EPH receptor B1
  ENSP ID: ENSP00000419688
MDTRTATAELGWTANPASGWEEVSGYDENLNTIRTYQVCNVF

SEQ ID NO: 27645 - protein, 281 aa, Homo sapiens
  Payload ID: 5452
  Gene Symbol: EPHB1
  Gene Name: EPH receptor B1
  ENSP ID: ENSP00000420338
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKVSRPFWRILRQQD

SEQ ID NO: 27646 - protein, 946 aa, Homo sapiens
  Payload ID: 5453
  Gene Symbol: EPHB2
  Gene Name: EPH receptor B2
  ENSP ID: ENSP00000363758
MWVPVLALPVCTYAETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKQELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMME

SEQ ID NO: 27647 - protein, 986 aa, Homo sapiens
  Payload ID: 5453
  Gene Symbol: EPHB2
  Gene Name: EPH receptor B2
  Uniprot ID: P29323
  ENSP ID: ENSP00000363761
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 27648 - protein, 987 aa, Homo sapiens
  Payload ID: 5453
  Gene Symbol: EPHB2
  Gene Name: EPH receptor B2
  Uniprot ID: P29323
  ENSP ID: ENSP00000363763
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 27649 - protein, 1055 aa, Homo sapiens
  Payload ID: 5453
  Gene Symbol: EPHB2
  Gene Name: EPH receptor B2
  Uniprot ID: P29323
  ENSP ID: ENSP00000383053
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 27650 - protein, 482 aa, Homo sapiens
  Payload ID: 5453
  Gene Symbol: EPHB2
  Gene Name: EPH receptor B2
  ENSP ID: ENSP00000444174
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKMKTQRS

SEQ ID NO: 27651 - protein, 998 aa, Homo sapiens
  Payload ID: 5454
  Gene Symbol: EPHB3
  Gene Name: EPH receptor B3
  Uniprot ID: P54753
  ENSP ID: ENSP00000332118
MARARPPPPPSPPPGLLPLLPPLLLLPLLLLPAGCRALEETLMDTKWVTSELAWTSHPESGWEEVSGYDEAMNPIRTYQVCNVRESSQNNWLRTGFIWRRDVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIPNAVEVSVPLKLYCNGDGEWMVPVGACTCATGHEPAAKESQCRPCPPGSYKAKQGEGPCLPCPPNSRTTSPAASICTCHNNFYRADSDSADSACTTVPSPPRGVISNVNETSLILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSSGSSLTLSWAPPERPNGVILDYEMKYFEKSEGIASTVTSQMNSVQLDGLRPDARYVVQVRARTVAGYGQYSRPAEFETTSERGSGAQQLQEQLPLIVGSATAGLVFVVAVVVIAIVCLRKQRHGSDSEYTEKLQQYIAPGMKVYIDPFTYEDPNEAVREFAKEIDVSCVKIEEVIGAGEFGEVCRGRLKQPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRWTAPEAIAYRKFTSASDVWSYGIVMWEVMSYGERPYWDMSNQDVINAVEQDYRLPPPMDCPTALHQLMLDCWVRDRNLRPKFSQIVNTLDKLIRNAASLKVIASAQSGMSQPLLDRTVPDYTTFTTVGDWLDAIKMGRYKESFVSAGFASFDLVAQMTAEDLLRIGVTLAGHQKKILSSIQDMRLQMNQTLPVQV

SEQ ID NO: 27652 - protein, 987 aa, Homo sapiens
  Payload ID: 5455
  Gene Symbol: EPHB4
  Gene Name: EPH receptor B4
  Uniprot ID: P54760
  ENSP ID: ENSP00000350896
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY

SEQ ID NO: 27653 - protein, 935 aa, Homo sapiens
  Payload ID: 5455
  Gene Symbol: EPHB4
  Gene Name: EPH receptor B4
  ENSP ID: ENSP00000353833
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGDLLRIGVTLAGHQKKILASVQHMKSQAKPGTPGGTGGPAPQY

SEQ ID NO: 27654 - protein, 306 aa, Homo sapiens
  Payload ID: 5455
  Gene Symbol: EPHB4
  Gene Name: EPH receptor B4
  Uniprot ID: P54760
  ENSP ID: ENSP00000482702
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRGRRGSQQRAVPEDVRKPGRAAGAEAGSQLPGAGTGAL

SEQ ID NO: 27655 - protein, 1022 aa, Homo sapiens
  Payload ID: 5456
  Gene Symbol: EPHB6
  Gene Name: EPH receptor B6
  ENSP ID: ENSP00000404786
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKASAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 27656 - protein, 729 aa, Homo sapiens
  Payload ID: 5456
  Gene Symbol: EPHB6
  Gene Name: EPH receptor B6
  ENSP ID: ENSP00000409061
MVAVGGCRCQPGYQPARGDKACQACPRGLYKASAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 27657 - protein, 183 aa, Homo sapiens
  Payload ID: 5456
  Gene Symbol: EPHB6
  Gene Name: EPH receptor B6
  ENSP ID: ENSP00000477807
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKRRRPVGLGGPPWWQLWAPVWLMQSQRRME

SEQ ID NO: 27658 - protein, 729 aa, Homo sapiens
  Payload ID: 5456
  Gene Symbol: EPHB6
  Gene Name: EPH receptor B6
  ENSP ID: ENSP00000481087
MVAVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 27659 - protein, 1022 aa, Homo sapiens
  Payload ID: 5456
  Gene Symbol: EPHB6
  Gene Name: EPH receptor B6
  ENSP ID: ENSP00000481418
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 27660 - protein, 1022 aa, Homo sapiens; identical to SEQ ID NO: 27655
  Payload ID: 5456
  Gene Symbol: EPHB6
  Gene Name: EPH receptor B6
  ENSP ID: ENSP00000481994

SEQ ID NO: 27661 - protein, 112 aa, Homo sapiens
  Payload ID: 5456
  Gene Symbol: EPHB6
  Gene Name: EPH receptor B6
  ENSP ID: ENSP00000481996
GERPYWDMSEQEVLNAIEQEFRLPPPPGCPPGLHLLMLDTWQKDRARRPHFDQLVAAFDKMIRKPDTLQAGGDPGERDLPALGITLAGHQKKLLHHIQLLQQHLRQQGSVEV

SEQ ID NO: 27662 - protein, 50 aa, Homo sapiens
  Payload ID: 5456
  Gene Symbol: EPHB6
  Gene Name: EPH receptor B6
  ENSP ID: ENSP00000482735
MATEGAAQLGNRVAGMVCSLWVLLLVSSVLALEVGRGECSGRPATPDSDL

SEQ ID NO: 27663 - protein, 1022 aa, Homo sapiens; identical to SEQ ID NO: 27659
  Payload ID: 5456
  Gene Symbol: EPHB6
  Gene Name: EPH receptor B6
  ENSP ID: ENSP00000487627

SEQ ID NO: 27664 - protein, 50 aa, Homo sapiens; identical to SEQ ID NO: 27662
  Payload ID: 5456
  Gene Symbol: EPHB6
  Gene Name: EPH receptor B6
  ENSP ID: ENSP00000487720

SEQ ID NO: 27665 - protein, 112 aa, Homo sapiens; identical to SEQ ID NO: 27661
  Payload ID: 5456
  Gene Symbol: EPHB6
  Gene Name: EPH receptor B6
  ENSP ID: ENSP00000488271

SEQ ID NO: 27666 - protein, 118 aa, Homo sapiens
  Payload ID: 5456
  Gene Symbol: EPHB6
  Gene Name: EPH receptor B6
  ENSP ID: ENSP00000488389
FGILMWEVMSYGERPYWDMSEQEVLNAIEQEFRLPPPPGCPPGLHLLMLDTWQKDRARRPHFDQLVAAFDKMIRKPDTLQAGGDPGERPGFQPLDWSATRTTSPSLASVPSVMWLSSA

SEQ ID NO: 27667 - protein, 183 aa, Homo sapiens; identical to SEQ ID NO: 27657
  Payload ID: 5456
  Gene Symbol: EPHB6
  Gene Name: EPH receptor B6
  ENSP ID: ENSP00000488531

SEQ ID NO: 27668 - protein, 183 aa, Homo sapiens
  Payload ID: 5457
  Gene Symbol: EFNA1
  Gene Name: ephrin-A1
  Uniprot ID: P20827
  ENSP ID: ENSP00000357391
MEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISHSPQAHDNPQEKRLAADDPEVRVLHSIGHSAAPRLFPLAWTVLLLPLLLLQTP

SEQ ID NO: 27669 - protein, 205 aa, Homo sapiens
  Payload ID: 5457
  Gene Symbol: EFNA1
  Gene Name: ephrin-A1
  Uniprot ID: P20827
  ENSP ID: ENSP00000357392
MEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISKPIHQHEDRCLRLKVTVSGKITHSPQAHDNPQEKRLAADDPEVRVLHSIGHSAAPRLFPLAWTVLLLPLLLLQTP

SEQ ID NO: 27670 - protein, 213 aa, Homo sapiens
  Payload ID: 5458
  Gene Symbol: EFNA2
  Gene Name: ephrin-A2
  Uniprot ID: O43921
  ENSP ID: ENSP00000215368
MAPAQRPLLPLLLLLLPLPPPPFARAEDAARANSDRYAVYWNRSNPRFHAGAGDDGGGYTVEVSINDYLDIYCPHYGAPLPPAERMEHYVLYMVNGEGHASCDHRQRGFKRWECNRPAAPGGPLKFSEKFQLFTPFSLGFEFRPGHEYYYISATPPNAVDRPCLRLKVYVRPTNETLYEAPEPIFTSNNSCSSPGGCRLFLSTIPVLWTLLGS

SEQ ID NO: 27671 - protein, 238 aa, Homo sapiens
  Payload ID: 5459
  Gene Symbol: EFNA3
  Gene Name: ephrin-A3
  Uniprot ID: P52797
  ENSP ID: ENSP00000357393
MAAAPLLLLLLLVPVPLLPLLAQGPGGALGNRHAVYWNSSNQHLRREGYTVQVNVNDYLDIYCPHYNSSGVGPGAGPGPGGGAEQYVLYMVSRNGYRTCNASQGFKRWECNRPHAPHSPIKFSEKFQRYSAFSLGYEFHAGHEYYYISTPTHNLHWKCLRMKVFVCCASTSHSGEKPVPTLPQFTMGPNVKINVLEDFEGENPQVPKLEKSISGTSPKREHLPLAVGIAFFLMTFLAS

SEQ ID NO: 27672 - protein, 193 aa, Homo sapiens
  Payload ID: 5460
  Gene Symbol: EFNA4
  Gene Name: ephrin-A4
  Uniprot ID: P52798
  ENSP ID: ENSP00000352789
MRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERNLPSHPKEPESSQDPLEEEGSLLPALGVPIQTDKMEH

SEQ ID NO: 27673 - protein, 201 aa, Homo sapiens
  Payload ID: 5460
  Gene Symbol: EFNA4
  Gene Name: ephrin-A4
  Uniprot ID: P52798
  ENSP ID: ENSP00000357394
MRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERKSESAHPVGSPGESGTSGWRGGDTPSPLCLLLLLLLLILRLLRIL

SEQ ID NO: 27674 - protein, 207 aa, Homo sapiens
  Payload ID: 5460
  Gene Symbol: EFNA4
  Gene Name: ephrin-A4
  Uniprot ID: P52798
  ENSP ID: ENSP00000414378
MRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERRARVLPRSPGGGGIPAACTGGANSDRQDGALMGEIRGSEVTLAGACPLITG

SEQ ID NO: 27675 - protein, 228 aa, Homo sapiens
  Payload ID: 5461
  Gene Symbol: EFNA5
  Gene Name: ephrin-A5
  Uniprot ID: P52803
  ENSP ID: ENSP00000328777
MLHVEMLTLVFLVLWMCVFSQDPGSKAVADRYAVYWNSSNPRFQRGDYHIDVCINDYLDVFCPHYEDSVPEDKTERYVLYMVNFDGYSACDHTSKGFKRWECNRPHSPNGPLKFSEKFQLFTPFSLGFEFRPGREYFYISSAIPDNGRRSCLKLKVFVRPTNSCMKTIGVHDRVFDVNDKVENSLEPADDTVHESAEPSRGENAAQTPRIPSRLLAILLFLLAMLLTL

SEQ ID NO: 27676 - protein, 201 aa, Homo sapiens
  Payload ID: 5461
  Gene Symbol: EFNA5
  Gene Name: ephrin-A5
  ENSP ID: ENSP00000426989
MLHVEMLTLVFLVLWMCVFSQDPGSKAVADRYAVYWNSSNPRFQRGDYHIDVCINDYLDVFCPHYEDSVPEDKTERYVLYMVNFDGYSACDHTSKGFKRWECNRPHSPNGPLKFSEKFQLFTPFSLGFEFRPGREYFYISSAIPDNGRRSCLKLKVFVRPTNDTVHESAEPSRGENAAQTPRIPSRLLAILLFLLAMLLTL

SEQ ID NO: 27677 - protein, 188 aa, Homo sapiens [sequence omitted]

SEQ ID NO: 27678 - protein, 346 aa, Homo sapiens
  Payload ID: 5462
  Gene Symbol: EFNB1
  Gene Name: ephrin-B1
  Uniprot ID: P98172
  ENSP ID: ENSP00000204961
MARPGQRWLGKWLVAMVVWALCRLATPLAKNLEPVSWSSLNPKFLSGKGLVIYPKIGDKLDIICPRAEAGRPYEYYKLYLVRPEQAAACSTVLDPNVLVTCNRPEQEIRFTIKFQEFSPNYMGLEFKKHHDYYITSTSNGSLEGLENREGGVCRTRTMKIIMKVGQDPNAVTPEQLTTSRPSKEADNTVKMATQAPGSRGSLGDSDGKHETVNQEEKSGPGASGGSSGDPDGFFNSKVALFAAVGAGCVIFLLIIIFLTVLLLKLRKRHRKHTQQRAAALSLSTLASPKGGSGTAGTEPSDIIIPLRTTENNYCPHYEKVSGDYGHPVYIVQEMPPQSPANIYYKV

SEQ ID NO: 27679 - protein, 333 aa, Homo sapiens
  Payload ID: 5463
  Gene Symbol: EFNB2
  Gene Name: ephrin-B2
  Uniprot ID: P52799
  ENSP ID: ENSP00000245323
MAVRRDSVWKYCWGVLMVLCRTAISKSIVLEPIYWNSSNSKFLPGQGLVLYPQIGDKLDIICPKVDSKTVGQYEYYKVYMVDKDQADRCTIKKENTPLLNCAKPDQDIKFTIKFQEFSPNLWGLEFQKNKDYYIISTSNGSLEGLDNQEGGVCQTRAMKILMKVGQDASSAGSTRNKDPTRRPELEAGTNGRSSTTSPFVKPNPGSSTDGNSAGHSGNNILGSEVALFAGIASGCIIFIVIIITLVVLLLKYRRRHRKHSPQHTTTLSLSTLATPKRSGNNNGSEPSDIIIPLRTADSVFCPHYEKVSGDYGHPVYIVQEMPPQSPANIYYKV

SEQ ID NO: 27680 - protein, 340 aa, Homo sapiens
  Payload ID: 5464
  Gene Symbol: EFNB3
  Gene Name: ephrin-B3
  Uniprot ID: Q15768
  ENSP ID: ENSP00000226091
MGPPHSGPGGVRVGALLLLGVLGLVSGLSLEPVYWNSANKRFQAEGGYVLYPQIGDRLDLLCPRARPPGPHSSPNYEFYKLYLVGGAQGRRCEAPPAPNLLLTCDRPDLDLRFTIKFQEYSPNLWGHEFRSHHDYYIIATSDGTREGLESLQGGVCLTRGMKVLLRVGQSPRGGAVPRKPVSEMPMERDRGAAHSLEPGKENLPGDPTSNATSRGAEGPLPPPSMPAVAGAAGGLALLLLGVAGAGGAMCWRRRRAKPSESRHPGPGSFGRGGSLGLGGGGGMGPREAEPGELGIALRGGGAADPPFCPHYEKVSGDYGHPVYIVQDGPPQSPPNIYYKV

SEQ ID NO: 27681 - protein, 1207 aa, Homo sapiens
  Payload ID: 5465
  Gene Symbol: EGF
  Gene Name: epidermal growth factor
  Uniprot ID: P01133
  ENSP ID: ENSP00000265171
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 27682 - protein, 1166 aa, Homo sapiens
  Payload ID: 5465
  Gene Symbol: EGF
  Gene Name: epidermal growth factor
  Uniprot ID: P01133
  ENSP ID: ENSP00000421384
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 27683 - protein, 1165 aa, Homo sapiens
  Payload ID: 5465
  Gene Symbol: EGF
  Gene Name: epidermal growth factor
  Uniprot ID: P01133
  ENSP ID: ENSP00000424316
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 27684 - protein, 1210 aa, Homo sapiens [sequence omitted]

SEQ ID NO: 27685 - protein, 628 aa, Homo sapiens
  Payload ID: 5466
  Gene Symbol: EGFR
  Gene Name: epidermal growth factor receptor
  Uniprot ID: P00533
  ENSP ID: ENSP00000342376
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGS

SEQ ID NO: 27686 - protein, 705 aa, Homo sapiens
  Payload ID: 5466
  Gene Symbol: EGFR
  Gene Name: epidermal growth factor receptor
  Uniprot ID: P00533
  ENSP ID: ENSP00000345973
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 27687 - protein, 1165 aa, Homo sapiens
  Payload ID: 5466
  Gene Symbol: EGFR
  Gene Name: epidermal growth factor receptor
  ENSP ID: ENSP00000395243
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 27688 - protein, 657 aa, Homo sapiens
  Payload ID: 5466
  Gene Symbol: EGFR
  Gene Name: epidermal growth factor receptor
  ENSP ID: ENSP00000410031
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGSYIVSHFPRSFYKMSVH

SEQ ID NO: 27689 - protein, 128 aa, Homo sapiens
  Payload ID: 5466
  Gene Symbol: EGFR
  Gene Name: epidermal growth factor receptor
  ENSP ID: ENSP00000413354
MFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQ

SEQ ID NO: 27690 - protein, 405 aa, Homo sapiens
  Payload ID: 5466
  Gene Symbol: EGFR
  Gene Name: epidermal growth factor receptor
  Uniprot ID: P00533
  ENSP ID: ENSP00000413843
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 27691 - protein, 1091 aa, Homo sapiens
  Payload ID: 5466
  Gene Symbol: EGFR
  Gene Name: epidermal growth factor receptor
  ENSP ID: ENSP00000415559
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 27692 - protein, 762 aa, Homo sapiens
  Payload ID: 5467
  Gene Symbol: EPS15
  Gene Name: epidermal growth factor receptor pathway substrate 15
  ENSP ID: ENSP00000360795
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 27693 - protein, 896 aa, Homo sapiens
  Payload ID: 5467
  Gene Symbol: EPS15
  Gene Name: epidermal growth factor receptor pathway substrate 15
  Uniprot ID: P42566
  ENSP ID: ENSP00000360798
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 27694 - protein, 90 aa, Homo sapiens
  Payload ID: 5467
  Gene Symbol: EPS15
  Gene Name: epidermal growth factor receptor pathway substrate 15
  ENSP ID: ENSP00000474739
  MOD_RES (1)..(1): Any amino acid
XAAAQLSLTQLSSGNPVYEKYYRQVDTGNTGRVLASDAAAFLKKSGLPDLILGKIWDLADTDGKGILNKQHDTSSPLLISGTSAAELPWA

SEQ ID NO: 27695 - protein, 864 aa, Homo sapiens
  Payload ID: 5468
  Gene Symbol: EPS15L1
  Gene Name: epidermal growth factor receptor pathway substrate 15-like 1
  Uniprot ID: Q9UBC2
  ENSP ID: ENSP00000248070
MAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKPPPSGPFTSSLGGAGFSDDPFKSKQDTPALPPKKPAPPRPKPPSGKSTPVSQLGSADFPEAPDPFQPLGADSGDPFQSKKGFGDPFSGKDPFVPSSAAKPSKASASGFADFTSVS

SEQ ID NO: 27696 - protein, 910 aa, Homo sapiens
  Payload ID: 5468
  Gene Symbol: EPS15L1
  Gene Name: epidermal growth factor receptor pathway substrate 15-like 1
  Uniprot ID: Q9UBC2
  ENSP ID: ENSP00000393313
MAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKPPPSGPFTSSLGGAGFSDDPFKSKQDTPALPPKKPAPPRPKPPSGKSTPVSQLGSADFPEAPDPFQPLGADSGDPFQSKKGFGDPFSGKDPFVPSSAAKPSKASASGFADFTSFGNEEQQLAWAKRESEKAEQERLARLRRQEQEDLELAIALSKADMPAA

SEQ ID NO: 27697 - protein, 754 aa, Homo sapiens
  Payload ID: 5468
  Gene Symbol: EPS15L1
  Gene Name: epidermal growth factor receptor pathway substrate 15-like 1
  Uniprot ID: Q9UBC2
  ENSP ID: ENSP00000440103
MAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKVKVHL

SEQ ID NO: 27698 - protein, 79 aa, Homo sapiens
  Payload ID: 5468
  Gene Symbol: EPS15L1
  Gene Name: epidermal growth factor receptor pathway substrate 15-like 1
  ENSP ID: ENSP00000465286
MAAPLIPLSQQIPTGNSLYESYYKQVDPAYTGRVGASEAALFLKKSGLSDIILGKIWDLADPEGFLCCTETGGLCTEWP

SEQ ID NO: 27699 - protein, 90 aa, Homo sapiens
  Payload ID: 5468
  Gene Symbol: EPS15L1
  Gene Name: epidermal growth factor receptor pathway substrate 15-like 1
  ENSP ID: ENSP00000468866
  MOD_RES (1)..(1): Any amino acid
XAAPLIPLSQQIPTGNSLYESYYKQVDPAYTGRVGASEAALFLKKSGLSDIILGKIWDLADPEGKGFLDKQVYTHVHRANGGAGQSPQAG

SEQ ID NO: 27700 - protein, 71 aa, Homo sapiens
  Payload ID: 5468
  Gene Symbol: EPS15L1
  Gene Name: epidermal growth factor receptor pathway substrate 15-like 1
  ENSP ID: ENSP00000469495
  MOD_RES (1)..(1): Any amino acid
XQTFPRPPIHSSHSGLTAATRSKFGNEEQQLAWAKRESEKAEQERLARLRRQEQEDLELAIALSKADMPAA

SEQ ID NO: 27701 - protein, 756 aa, Homo sapiens
  Payload ID: 5468
  Gene Symbol: EPS15L1
  Gene Name: epidermal growth factor receptor pathway substrate 15-like 1
  ENSP ID: ENSP00000471662
MAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMVKDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKVKVHL

SEQ ID NO: 27702 - protein, 754 aa, Homo sapiens; identical to SEQ ID NO: 27697
  Payload ID: 5468
  Gene Symbol: EPS15L1
  Gene Name: epidermal growth factor receptor pathway substrate 15-like 1
  Uniprot ID: Q9UBC2
  ENSP ID: ENSP00000471981

SEQ ID NO: 27703 - protein, 110 aa, Homo sapiens
  Payload ID: 5468
  Gene Symbol: EPS15L1
  Gene Name: epidermal growth factor receptor pathway substrate 15-like 1
  ENSP ID: ENSP00000472135
MAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFQTHPPMI

SEQ ID NO: 27704 - protein, 601 aa, Homo sapiens
  Payload ID: 5468
  Gene Symbol: EPS15L1
  Gene Name: epidermal growth factor receptor pathway substrate 15-like 1
  Uniprot ID: Q9UBC2
  ENSP ID: ENSP00000472267
MAAPLIPLSQQIPTGNSLYESYYKQVDPAYTGRVGASEAALFLKKSGLSDIILGKIWDLADPEGKGFLDKQGFYVALRLVACAQSGHEVTLSNLNLSMPPPKFHDTSSPLMVTPPSAEAHWAVRVEEKAKFDGIFESLLPINGLLSGDKVKPVLMNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMVKVE

SEQ ID NO: 27705 - protein, 447 aa, Homo sapiens
  Payload ID: 5468
  Gene Symbol: EPS15L1
  Gene Name: epidermal growth factor receptor pathway substrate 15-like 1
  ENSP ID: ENSP00000472771
MNSKLPLDVLGRVWDLSDIDKDGHLDRDEFAVAMHLVYRALEKEPVPSALPPSLIPPSKRKKTVFPGAVPVLPASPPPKDSLRSTPSHGSVSSLNSTGSLSPKHSLKQTQPTVNWVVPVADKMRFDEIFLKTDLDLDGYVSGQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQELEAQKQDAQDRLDEMDQQKAKLRDMLSDVRQKCQDETQMISSLKTQIQSQESDLKSQEDDLNRAKSELNRLQQEETQLEQSIQAGRVQLETIIKSLKSTQDEINQARSKLSQLHESRQEAHRSLEQYDQVLDGAHGASLTDLANLSEGVSLAERGSFGAMVKVE

SEQ ID NO: 27706 - protein, 83 aa, Homo sapiens
  Payload ID: 5468
  Gene Symbol: EPS15L1
  Gene Name: epidermal growth factor receptor pathway substrate 15-like 1
  ENSP ID: ENSP00000472958
MAAPLIPLSQQIPTGNSLYESYYKQVDPAYTGRVGASEAALFLKKSGLSDIILGKKRPNLMGFLKASCPSMVCSLETKSSQSS

SEQ ID NO: 27707 - protein, 213 aa, Homo sapiens
  Payload ID: 5468
  Gene Symbol: EPS15L1
  Gene Name: epidermal growth factor receptor pathway substrate 15-like 1
  ENSP ID: ENSP00000473242
  MOD_RES (1)..(1): Any amino acid
XEINQARSKLSQLHESRQEAHRSLEQYDQVLDGAHGASLTDLANLSEGVSLAERGSFGAMDDPFKNKALLFSNNTQELHPDPFQTEDPFKSDPFKGADPFKGDPFQNDPFAEQQTTSTDPFGGDPFKESDPFRGSATDDFFKKQTKNDPFTSDPFTKNPSLPSKLDPFESSDPFSSSSVSSKGSDPFGTLDPFGSGSFNSAEGFADFSQMSKE

SEQ ID NO: 27708 - protein, 822 aa, Homo sapiens
  Payload ID: 5469
  Gene Symbol: EPS8
  Gene Name: epidermal growth factor receptor pathway substrate 8
  Uniprot ID: Q12929
  ENSP ID: ENSP00000281172
MNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENFPLNTIQHCQAVMHSCSYDSVLALVCKEPTQNKPDLHLFQCDEVKANLISEDIESAISDSKGGKQKRRPDALRMISNADPSIPPPPRAPAPAPPGTVTQVDVRSRVAAWSAWAADQGDFEKPRQYHEQEETPEMMAARIDRDVQILNHILDDIEFFITKLQKAAEAFSELSKRKKNKKGKRKGPGEGVLTLRAKPPPPDEFLDCFQKFKHGFNLLAKLKSHIQNPSAADLVHFLFTPLNMVVQATGGPELASSVLSPLLNKDTIDFLNYTVNGDERQLWMSLGGTWMKARAEWPKEQFIPPYVPRFRNGWEPPMLNFMGATMEQDLYQLAESVANVAEHQRKQEIKRLSTEHSSVSEYHPADGYAFSSNIYTRGSHLDQGEAAVAFKPTSNRHIDRNYEPLKTQPKKYAKSKYDFVARNNSELSVLKDDILEILDDRKQWWKVRNASGDSGFVPNNILDIVRPPESGLGRADPPYTHTIQKQRMEYGPRPADTPPAPSPPPTPAPVPVPLPPSTPAPVPVSKVPANITRQNSSSSDSGGSIVRDSQRHKQLPVDRRKSQMEEVQDELIHRLTIGRSAAQKKFHVPRQNVPVINITYDSTPEDVKTWLQSKGFNPVTVNSLGVLNGAQLFSLNKDELRTVCPEGARVYSQITVQKAALEDSSGSSELQEIMRRRQEKISAAASDSGVESFDEGSSH

SEQ ID NO: 27709 - protein, 562 aa, Homo sapiens
  Payload ID: 5469
  Gene Symbol: EPS8
  Gene Name: epidermal growth factor receptor pathway substrate 8
  Uniprot ID: Q12929
  ENSP ID: ENSP00000437806
MMAARIDRDVQILNHILDDIEFFITKLQKAAEAFSELSKRKKNKKGKRKGPGEGVLTLRAKPPPPDEFLDCFQKFKHGFNLLAKLKSHIQNPSAADLVHFLFTPLNMVVQATGGPELASSVLSPLLNKDTIDFLNYTVNGDERQLWMSLGGTWMKARAEWPKEQFIPPYVPRFRNGWEPPMLNFMGATMEQDLYQLAESVANVAEHQRKQEIKRLSTEHSSVSEYHPADGYAFSSNIYTRGSHLDQGEAAVAFKPTSNRHIDRNYEPLKTQPKKYAKSKYDFVARNNSELSVLKDDILEILDDRKQWWKVRNASGDSGFVPNNILDIVRPPESGLGRADPPYTHTIQKQRMEYGPRPADTPPAPSPPPTPAPVPVPLPPSTPAPVPVSKVPANITRQNSSSSDSGGSIVRDSQRHKQLPVDRRKSQMEEVQDELIHRLTIGRSAAQKKFHVPRQNVPVINITYDSTPEDVKTWLQSKGFNPVTVNSLGVLNGAQLFSLNKDELRTVCPEGARVYSQITVQKAALEDSSGSSELQEIMRRRQEKISAAASDSGVESFDEGSSH

SEQ ID NO: 27710 - protein, 68 aa, Homo sapiens
  Payload ID: 5469
  Gene Symbol: EPS8
  Gene Name: epidermal growth factor receptor pathway substrate 8
  ENSP ID: ENSP00000438490
  MOD_RES (1)..(1): Any amino acid
XDIESAISDSKGGKQKRRPDALRMISNADPSIPPPPRAPAPAPPGTVTQVDVRSRVAAWSAWAADQGD

SEQ ID NO: 27711 - protein, 68 aa, Homo sapiens
  Payload ID: 5469
  Gene Symbol: EPS8
  Gene Name: epidermal growth factor receptor pathway substrate 8
  ENSP ID: ENSP00000438668
MNGHISNHPSSFGMYPSQMNGYGSSPTFSQTDREHGSKTSAKALYEQRKNYARDSVSSVSDISQYRVE

SEQ ID NO: 27712 - protein, 120 aa, Homo sapiens
  Payload ID: 5469
  Gene Symbol: EPS8
  Gene Name: epidermal growth factor receptor pathway substrate 8
  ENSP ID: ENSP00000440591
MNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLE

SEQ ID NO: 27713 - protein, 822 aa, Homo sapiens; identical to SEQ ID NO: 27708
  Payload ID: 5469
  Gene Symbol: EPS8
  Gene Name: epidermal growth factor receptor pathway substrate 8
  Uniprot ID: Q12929
  ENSP ID: ENSP00000441867

SEQ ID NO: 27714 - protein, 562 aa, Homo sapiens; identical to SEQ ID NO: 27709
  Payload ID: 5469
  Gene Symbol: EPS8
  Gene Name: epidermal growth factor receptor pathway substrate 8
  Uniprot ID: Q12929
  ENSP ID: ENSP00000441888

SEQ ID NO: 27715 - protein, 822 aa, Homo sapiens; identical to SEQ ID NO: 27708
  Payload ID: 5469
  Gene Symbol: EPS8
  Gene Name: epidermal growth factor receptor pathway substrate 8
  Uniprot ID: Q12929
  ENSP ID: ENSP00000442388

SEQ ID NO: 27716 - protein, 41 aa, Homo sapiens
  Payload ID: 5469
  Gene Symbol: EPS8
  Gene Name: epidermal growth factor receptor pathway substrate 8
  ENSP ID: ENSP00000442883
MNGHISNHPSSFGMYPSQMKTKEELCTGQCQQCVRYISIPC

SEQ ID NO: 27717 - protein, 68 aa, Homo sapiens; identical to SEQ ID NO: 27711
  Payload ID: 5469
  Gene Symbol: EPS8
  Gene Name: epidermal growth factor receptor pathway substrate 8
  ENSP ID: ENSP00000444613

SEQ ID NO: 27718 - protein, 128 aa, Homo sapiens
  Payload ID: 5469
  Gene Symbol: EPS8
  Gene Name: epidermal growth factor receptor pathway substrate 8
  ENSP ID: ENSP00000445235
MNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENF

SEQ ID NO: 27719 - protein, 67 aa, Homo sapiens
  Payload ID: 5469
  Gene Symbol: EPS8
  Gene Name: epidermal growth factor receptor pathway substrate 8
  ENSP ID: ENSP00000445815
MNGHISNHPSSFGMYPSQMNGYGSSPTFSQTDREHGSKTSAKALYEQRKNYARDSVSSVSDISQYRV

SEQ ID NO: 27720 - protein, 200 aa, Homo sapiens
  Payload ID: 5469
  Gene Symbol: EPS8
  Gene Name: epidermal growth factor receptor pathway substrate 8
  ENSP ID: ENSP00000445985
MNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENFPLNTIQHCQAVMHSCSYDSVLALVCKEPTQNKPDLHLFQCDEVKANLISEDIESAISDSKGGKQKRRPDALS

SEQ ID NO: 27721 - protein, 117 aa, Homo sapiens
  Payload ID: 5470
  Gene Symbol: EPPIN
  Gene Name: epididymal peptidase inhibitor
  Uniprot ID: O95925
  ENSP ID: ENSP00000338114
MLSKAHGCKTALSLGRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKRFP

SEQ ID NO: 27722 - protein, 133 aa, Homo sapiens
  Payload ID: 5470
  Gene Symbol: EPPIN
  Gene Name: epididymal peptidase inhibitor
  Uniprot ID: O95925
  ENSP ID: ENSP00000361746
MGSSGLLSLLVLFVLLANVQGPGLTDWLFPRRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKRFP

SEQ ID NO: 27723 - protein, 77 aa, Homo sapiens
  Payload ID: 5470
  Gene Symbol: EPPIN
  Gene Name: epididymal peptidase inhibitor
  ENSP ID: ENSP00000387153
MGSSGLLSLLVLFVLLANVQGPGLTDWLFPRRCPKIREECEFQERDVCTKDRQCQDNKKCCVFSCGKKCLDLKQGKQ

SEQ ID NO: 27724 - protein, 147 aa, Homo sapiens
  Payload ID: 5471
  Gene Symbol: EDDM3A
  Gene Name: epididymal protein 3A
  Uniprot ID: Q14507
  ENSP ID: ENSP00000315098
MTSSLKIWGILLALLCILCRLCVYSNNIYWREFIKLHYLSPSREFKEYKCDVLMREKEALKGKSFHMFIYSLWFKIQRACINEKGSDRYRNAYVWAPGALKVLECHWEKYNNRYTESRSFSYIEFHCGVDGYVDNIEDLRIIEPISN

SEQ ID NO: 27725 - protein, 147 aa, Homo sapiens
  Payload ID: 5471
  Gene Symbol: EDDM3A
  Gene Name: epididymal protein 3A
  ENSP ID: ENSP00000479026
MASSLKIWGSPLALLCILCRLLVHSKDVSWREFIKLHYLSPSREFKEYKCDVLMREKEALKGKSFHMFIYSLWFKIQRACINEKGSDRYRNAYVWAPGALKVLECHWEKYNNRYTESRSFSYIEFHCGVDGYVDNIEDLRIIEPISN

SEQ ID NO: 27726 - protein, 147 aa, Homo sapiens
  Payload ID: 5472
  Gene Symbol: EDDM3B
  Gene Name: epididymal protein 3B
  Uniprot ID: P56851
  ENSP ID: ENSP00000314810
MASSLKIWGTLLALLCILCTLLVQSKEVSWREFMKQHYLSPSREFREYKCDVLMRENEALKDKSSHMFIYISWYKIEHICTSDNWMDRFRNAYVWVQNPLKVLKCHQENSKNSYTESRSFNYIEFHCSMDGYVDSIEDLKMVEPIGN

SEQ ID NO: 27727 - protein, 223 aa, Homo sapiens [sequence omitted]

SEQ ID NO: 27728 - protein, 76 aa, Homo sapiens
  Payload ID: 5473
  Gene Symbol: ELSPBP1
  Gene Name: epididymal sperm binding protein 1
  ENSP ID: ENSP00000470551
SNKLWCPTTENMDKDGKWSFCADTRISALVPGFPCHFPFNYKNKNYFNCTNEGSKENLVWCATSYNYDQDHTWVYC

SEQ ID NO: 27729 - protein, 150 aa, Homo sapiens
  Payload ID: 5473
  Gene Symbol: ELSPBP1
  Gene Name: epididymal sperm binding protein 1
  ENSP ID: ENSP00000470903
MTRWSSYLLGWTTFLLYSYESSGDYPRCIFPFIYRGKAYNSCISQGSFLGSLWCSVTSVFDEKQQWKFCETNEYGGNSLRKPCIFPSIYRNNVVSDCMEDESNKLWCPTTENMDKDGKWSFCADTRISALVPGFPCHFPFNYKNKNYFNC

SEQ ID NO: 27730 - protein, 75 aa, Homo sapiens
  Payload ID: 5473
  Gene Symbol: ELSPBP1
  Gene Name: epididymal sperm binding protein 1
  ENSP ID: ENSP00000471690
MTRWSSYLLGWTTFLLYSYESSGGISALVPGFPCHFPFNYKNKNYFNCTNEGSKENLVWCATSYNYDQDHTWVYC

SEQ ID NO: 27731 - protein, 154 aa, Homo sapiens
  Payload ID: 5473
  Gene Symbol: ELSPBP1
  Gene Name: epididymal sperm binding protein 1
  ENSP ID: ENSP00000472960
  MOD_RES (1)..(1): Any amino acid
XYPRCIFPFIYRGKAYNSCISQGSFLGSLWCSVTSVFDEKQQWKFCETNEYGGNSLRKPCIFPSIYRNNVVSDCMEDESNKLWCPTTENMDKDGKWSFCADTRISALVPGFPCHFPFNYKNKNYFNCTNEGSKENLVWCATSYNYDQDHTWVYC

SEQ ID NO: 27732 - protein, 220 aa, Homo sapiens
  Payload ID: 5473
  Gene Symbol: ELSPBP1
  Gene Name: epididymal sperm binding protein 1
  ENSP ID: ENSP00000481506
MVQLPVGWTTFLLYSYESSGGMHEECVFPFTYKGSVYFTCTHIHSLSPWCATRAVYNGQWKYCQSEDYPRCIFPFIYRGKAYNSCISQGSFLGSLWCSVTSVFDEKQQWKFCETNEYGGNSLRKPCIFPSIYRNNVVSDCMEDESNKLWCPTTENMDKDGKWSFCADTRISALVPGFPCHFPFNYKNKNYFNCTNEGSKENLVWCATSYNYDQDHTWVYC

SEQ ID NO: 27733 - protein, 331 aa, Homo sapiens
  Payload ID: 5474
  Gene Symbol: EPM2A
  Gene Name: epilepsy, progressive myoclonus type 2A, Lafora disease (laforin)
  Uniprot ID: O95278
  ENSP ID: ENSP00000356489
MRFRFGVVVPPAVAGARPELLVVGSRPELGRWEPRGAVRLRPAGTAAGDGALALQEPGLWLGEVELAAEEAAQDGAEPGRVDTFWYKFLKREPGGELSWEGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEALARAQEDFFQKFGKVRSSVCSL

SEQ ID NO: 27734 - protein, 237 aa, Homo sapiens
  Payload ID: 5474
  Gene Symbol: EPM2A
  Gene Name: epilepsy, progressive myoclonus type 2A, Lafora disease (laforin)
  ENSP ID: ENSP00000405913
  MOD_RES (1)..(1): Any amino acid
XDTFWYKFLKREPGGELSWEGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEAASQDTFPL

SEQ ID NO: 27735 - protein, 170 aa, Homo sapiens
  Payload ID: 5474
  Gene Symbol: EPM2A
  Gene Name: epilepsy, progressive myoclonus type 2A, Lafora disease (laforin)
  ENSP ID: ENSP00000414900
  MOD_RES (1)..(1): Any amino acid
XNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEDEKRTADMCCSGMWEETADFGLGILDYLKQK

SEQ ID NO: 27736 - protein, 193 aa, Homo sapiens
  Payload ID: 5474
  Gene Symbol: EPM2A
  Gene Name: epilepsy, progressive myoclonus type 2A, Lafora disease (laforin)
  Uniprot ID: O95278
  ENSP ID: ENSP00000480268
MKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEALARAQEDFFQKFGKVRSSVCSL

SEQ ID NO: 27737 - protein, 317 aa, Homo sapiens
  Payload ID: 5474
  Gene Symbol: EPM2A
  Gene Name: epilepsy, progressive myoclonus type 2A, Lafora disease (laforin)
  Uniprot ID: O95278
  ENSP ID: ENSP00000480339
MRFRFGVVVPPAVAGARPELLVVGSRPELGRWEPRGAVRLRPAGTAAGDGALALQEPGLWLGEVELAAEEAAQDGAEPGRVDTFWYKFLKREPGGELSWEGNGPHHDRCCTYNENNLVDGVYCLPIGHWIEATGHTNEMKHTTDFYFNIAGHQAMHYSRILPNIWLGSCPRQVEHVTIKLKHELGITAVMNFQTEWDIVQNSSGCNRYPEPMTPDTMIKLYREEGLAYIWMPTPDMSTEGRVQMLPQAVCLLHALLEKGHIVYVHCNAGVGRSTAAVCGWLQYVMGWNLRKVQYFLMAKRPAVYIDEEAASQDTFPL

SEQ ID NO: 27738 - protein, 322 aa, Homo sapiens
  Payload ID: 5475
  Gene Symbol: EPYC
  Gene Name: epiphycan
  Uniprot ID: Q99645
  ENSP ID: ENSP00000261172
MKTLAGLVLGLVIFDAAVTAPTLESINYDSETYDATLEDLDNLYNYENIPVDKVEIEIATVMPSGNRELLTPPPQPEKAQEEEEEEESTPRLIDGSSPQEPEFTGVLGPHTNEDFPTCLLCTCISTTVYCDDHELDAIPPLPKNTAYFYSRFNRIKKINKNDFASLSDLKRIDLTSNLISEIDEDAFRKLPQLRELVLRDNKIRQLPELPTTLTFIDISNNRLGRKGIKQEAFKDMYDLHHLYLTDNNLDHIPLPLPENLRALHLQNNNILEMHEDTFCNVKNLTYIRKALEDIRLDGNPINLSKTPQAYMCLPRLPVGSLV

SEQ ID NO: 27739 - protein, 234 aa, Homo sapiens
  Payload ID: 5475
  Gene Symbol: EPYC
  Gene Name: epiphycan
  ENSP ID: ENSP00000448272
MKTLAGLVLGLVIFDAAVTAPTLESINYDSETYDATLEDLDNLYNYENIPVDKVEIEIATVMPSGNRELLTPPPQPEKAQEEEEEEESTPRLIDGSSPQEPEFTGVLGPHTNEDFPTCLLCTCISTTVYCDDHELDAIPPLPKNTAYFYSRFNRIKKINKNDFASLSDLKRIDLTSNLISEIDEDAFRKLPQLRELVLRDNKIRQLPELPTTLTFIDISNNRLGRKGIKQEAFK

SEQ ID NO: 27740 - protein, 5063 aa, Homo sapiens
  Payload ID: 5476
  Gene Symbol: EPPK1
  Gene Name: epiplakin 1
  ENSP ID: ENSP00000456124
MAATLGAGTPPRPQARSIAGVYVEASGQAQSVYAAMEQGLLPAGLGQALLEAQAATGGLVDLARGQLLPVSKALQQGLVGLELKEKLLAAERATTGYPDPYGGEKLALFQAIGKEVVDRALGQSWLEVQLATGGLVDPAQGVLVAPEPACHQGLLDRETWHKLSELEPGTGDLRFLDPNTLERLTYHQLLERCVRAPGSGLALLPLKITFRSMGGAVSAAELLEVGILDEQAVQGLREGRLAAVDVSARAEVRRYLEGTGSVAGVVLLPEGHKKSFFQAATEHLLPMGTALPLLEAQAATHTLVDPITGQRLWVDEAVRAGLVSPELHEQLLVAEQAVTGHHDPFSGSQIPLFQAMKKGLVDRPLALRLLDAQLATGGLVCPARRLRLPLEAALRCGCLDEDTQRQLSQAGSFSDGTHGGLRYEQLLALCVTDPETGLAFLPLSGGPRGGEPQGPPFIKYSTRQALSTATATVSVGKFRGRPVSLWELLFSEAISSEQRAMLAQQYQEGTLSVEKLAAKLSATLEQAAATARVTFSGLRDTVTPGELLKAEIIDQDLYERLEHGQATAKDVGSLASVQRYLQGTGCIAGLLLPGSQERLSIYEARCKGLLRPGTALILLEAQAATGFIIDPKANKGHSVEEALRAAVIGPDVFAKLLSAERAVTGYTDPYTGQQISLFQAMQKGLIVREHGIRLLEAQIATGGVIDPVHSHRVPVDVAYRRGYFDQMLNLILLDPSDDTKGFFDPNTHENLTYLQLLERCVRDPETGLYLLPLSSTQSPLVDSATQQAFQNLLLSVKYGRFQGQRVSAWELINSEYFSEGRRRQLLRRYRQREVTLGQVAKLLEAETQRQADIMLPALRSRVTVHQLLEAGIIDQQLLDQVLAGTISPEALLLMDGVRRYLCGLGAVGGVRLLPSGQRLSLYQAMRQKLLGPRVALALLEAQAATGTIMDPHSPESLSVDEAVRRGVVGPELYGRLKRAEGAIAGFRDPFSGKQVSVFQAMKKGLIPWEQAARLLEAQVATGGIIDPTSHHHLPMPVAIQRGYVDQEMETALSSSSETFPTPDGQGRTSYAQLLEECPRDETSGLHLLPLPESAPALPTEEQVQRSLQAVPGAKDGTSLWDLLSSCHFTEEQRRGLLEDVQEGRTTVPQLLASVQRWVQETKLLAQARVMVPGPRGEVPAVWLLDAGIITQETLEALAQGTQSPAQVAEQPAVKACLWGTGCVAGVLLQPSGAKASIAQAVRDGLLPTGLGQRLLEAQVASGFLVDPLNNQRLSVEDAVKVGLVGRELSEQLGQAERAAAGYPDPYSRASLSLWQAMEKGLVPQNEGLPLLQVQLATGGVVDPVHGVHLPQAAACRLGLLDTQTSQVLTAVDKDNKFFFDPSARDQVTYQQLRERCVCDSETGLLLLPLPSDTVLEVDDHTAVALRAMKVPVSTGRFKGCSVSLWDLLLSEYVGADKRRELVALCRSGRAAALRQVVSAVTTLVEAAERQPLQATFRGLRKQVSARDLFRAQLISRKTLDELSQGTTTVKEVAEMDSVKRSLEGGNFIAGVLIQGTQERMSIPEALRRHILRPGTALVLLEAQAATGFIIDPVENRKLTVEEAFKAGMFGKETYVKLLSAERAVTGYTDPYTGQQISLFQAMQKDLIVREHGIRLLEAQIATGGIIDPVHSHRVPVDVAYRCGYFDEEMNRILADPSDDTKGFFDPNTHENLTYLQLLERCVEDPETGLYLLQIIKKGENYVYINEATRHVLQSRTAKMRVGRFADQVVSFWDLLSSPYFTEDRKRELIQEYGAQSGGLEKLLEIITTTIEETETQNQGIKVAAIRGEVTAADLFNSRVIDQKTLHTLRVGRTGGQALSTLECVKPYLEGSGCIAGVTVPSTREVMSLHEASRKELIPAAFATWLLEAQAATGFLLDPCTRQKLSVDEAVDVGLVNEELRERLLKAERAATGYRDPATGDTIPLFQAMQKQLIEKAEALRLLEVQVATGGVIDPQHHHRLPLETAYRRGCLHKDIYALISDQKHMRKRFVDPNTQEKVSYRELQERCRPQEDTGWLLFPVNKAARDSEHIDDETRRALEAEQVEITVGRFRGQKPTLWALLNSEYVTEEKKLQLVRMYRTHTRRALQTVAQLILELIEKQETSNKHLWFQGIRRQITASELLSSAIITEEMLQDLETGRSTTQELMEDDRVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYQRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAAARRQEQTLRDATMEVQRGQFQGRPVSVWDVLFSSYLSEARRDELLAQHAAGALGLPDLVAVLTRVIEETEERLSKVSFRGLRCQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAATAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAATAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGHQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLAHPSDDTKGFFDPNTHENLTYVQLLRRCVPDPDTGLYMLQLAGRGSAVHQLSEELRCALRDARVMPGSGALQGQSVSVWELLFYREVSEDRRQDLLSRYRAGTLTVEELGATLTSLLAQAQAQARAEAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAARRQEQTLRDATMEVQRGQFQGRPVSVWDVLFSSYLSEAHRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYLQLLQRATLDPETGLLFLSLSLQ

SEQ ID NO: 27741 - protein, 5088 aa, Homo sapiens
  Payload ID: 5476
  Gene Symbol: EPPK1
  Gene Name: epiplakin 1
  ENSP ID: ENSP00000484472
MSGHTLPPLPVPGTNSTEQASVPRAMAATLGAGTPPRPQARSIAGVYVEASGQAQSVYAAMEQGLLPAGLGQALLEAQAATGGLVDLARGQLLPVSKALQQGLVGLELKEKLLAAERATTGYPDPYGGEKLALFQAIGKEVVDRALGQSWLEVQLATGGLVDPAQGVLVAPEPACHQGLLDRETWHKLSELEPGTGDLRFLDPNTLERLTYHQLLERCVRAPGSGLALLPLKITFRSMGGAVSAAELLEVGILDEQAVQGLREGRLAAVDVSARAEVRRYLEGTGSVAGVVLLPEGHKKSFFQAATEHLLPMGTALPLLEAQAATHTLVDPITGQRLWVDEAVRAGLVSPELHEQLLVAEQAVTGHHDPFSGSQIPLFQAMKKGLVDRPLALRLLDAQLATGGLVCPARRLRLPLEAALRCGCLDEDTQRQLSQAGSFSDGTHGGLRYEQLLALCVTDPETGLAFLPLSGGPRGGEPQGPPFIKYSTRQALSTATATVSVGKFRGRPVSLWELLFSEAISSEQRAMLAQQYQEGTLSVEKLAAKLSATLEQAAATARVTFSGLRDTVTPGELLKAEIIDQDLYERLEHGQATAKDVGSLASVQRYLQGTGCIAGLLLPGSQERLSIYEARCKGLLRPGTALILLEAQAATGFIIDPKANKGHSVEEALRAAVIGPDVFAKLLSAERAVTGYTDPYTGQQISLFQAMQKGLIVREHGIRLLEAQIATGGVIDPVHSHRVPVDVAYRRGYFDQMLNLILLDPSDDTKGFFDPNTHENLTYLQLLERCVRDPETGLYLLPLSSTQSPLVDSATQQAFQNLLLSVKYGRFQGQRVSAWELINSEYFSEGRRRQLLRRYRQREVTLGQVAKLLEAETQRQADIMLPALRSRVTVHQLLEAGIIDQQLLDQVLAGTISPEALLLMDGVRRYLCGLGAVGGVRLLPSGQRLSLYQAMRQKLLGPRVALALLEAQAATGTIMDPHSPESLSVDEAVRRGVVGPELYGRLKRAEGAIAGFRDPFSGKQVSVFQAMKKGLIPWEQAARLLEAQVATGGIIDPTSHHHLPMPVAIQRGYVDQEMETALSSSSETFPTPDGQGRTSYAQLLEECPRDETSGLHLLPLPESAPALPTEEQVQRSLQAVPGAKDGTSLWDLLSSCHFTEEQRRGLLEDVQEGRTTVPQLLASVQRWVQETKLLAQARVMVPGPRGEVPAVWLLDAGIITQETLEALAQGTQSPAQVAEQPAVKACLWGTGCVAGVLLQPSGAKASIAQAVRDGLLPTGLGQRLLEAQVASGFLVDPLNNQRLSVEDAVKVGLVGRELSEQLGQAERAAAGYPDPYSRASLSLWQAMEKGLVPQNEGLPLLQVQLATGGVVDPVHGVHLPQAAACRLGLLDTQTSQVLTAVDKDNKFFFDPSARDQVTYQQLRERCVCDSETGLLLLPLPSDTVLEVDDHTAVALRAMKVPVSTGRFKGCSVSLWDLLLSEYVGADKRRELVALCRSGRAAALRQVVSAVTTLVEAAERQPLQATFRGLRKQVSARDLFRAQLISRKTLDELSQGTTTVKEVAEMDSVKRSLEGGNFIAGVLIQGTQERMSIPEALRRHILRPGTALVLLEAQAATGFIIDPVENRKLTVEEAFKAGMFGKETYVKLLSAERAVTGYTDPYTGQQISLFQAMQKDLIVREHGIRLLEAQIATGGIIDPVHSHRVPVDVAYRCGYFDEEMNRILADPSDDTKGFFDPNTHENLTYLQLLERCVEDPETGLYLLQIIKKGENYVYINEATRHVLQSRTAKMRVGRFADQVVSFWDLLSSPYFTEDRKRELIQEYGAQSGGLEKLLEIITTTIEETETQNQGIKVAAIRGEVTAADLFNSRVIDQKTLHTLRVGRTGGQALSTLECVKPYLEGSGCIAGVTVPSTREVMSLHEASRKELIPAAFATWLLEAQAATGFLLDPCTRQKLSVDEAVDVGLVNEELRERLLKAERAATGYRDPATGDTIPLFQAMQKQLIEKAEALRLLEVQVATGGVIDPQHHHRLPLETAYRRGCLHKDIYALISDQKHMRKRFVDPNTQEKVSYRELQERCRPQEDTGWLLFPVNKAARDSEHIDDETRRALEAEQVEITVGRFRGQKPTLWALLNSEYVTEEKKLQLVRMYRTHTRRALQTVAQLILELIEKQETSNKHLWFQGIRRQITASELLSSAIITEEMLQDLETGRSTTQELMEDDRVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYQRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAAARRQEQTLRDATMEVQRGQFQGRPVSVWDVLFSSYLSEARRDELLAQHAAGALGLPDLVAVLTRVIEETEERLSKVSFRGLRCQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAATAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAATAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGHQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLAHPSDDTKGFFDPNTHENLTYVQLLRRCVPDPDTGLYMLQLAGRGSAVHQLSEELRCALRDARVMPGSGALQGQSVSVWELLFYREVSEDRRQDLLSRYRAGTLTVEELGATLTSLLAQAQAQARAEAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAARRQEQTLRDATMEVQRGQFQGRPVSVWDVLFSSYLSEAHRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYLQLLQRATLDPETGLLFLSLSLQ

SEQ ID NO: 27742 - protein, 169 aa, Homo sapiens
  Payload ID: 5477
  Gene Symbol: EREG
  Gene Name: epiregulin
  Uniprot ID: O14944
  ENSP ID: ENSP00000244869
MTAGRRMEMLCAGRVPALLLCLGFHLLQAVLSTTVIPSCIPGESSDNCTALVQTEDNPRVAQVSITKCSSDMNGYCLHGQCIYLVDMSQNYCRCEVGYTGVRCEHFFLTVHQPLSKEYVALTVILIILFLITVVGSTYYFCRWYRNRKSKEPKKEYERVTSGDPELPQV

SEQ ID NO: 27743 - protein, 314 aa, Homo sapiens
  Payload ID: 5478
  Gene Symbol: EPCAM
  Gene Name: epithelial cell adhesion molecule
  Uniprot ID: P16422
  ENSP ID: ENSP00000263735
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 27744 - protein, 342 aa, Homo sapiens
  Payload ID: 5478
  Gene Symbol: EPCAM
  Gene Name: epithelial cell adhesion molecule
  ENSP ID: ENSP00000385476
METKHLGRGGAGRAGPHLWRGPRPNCSAGAGGGEPTHSPNSRAVTHQRAPAARECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 27745 - protein, 199 aa, Homo sapiens
  Payload ID: 5478
  Gene Symbol: EPCAM
  Gene Name: epithelial cell adhesion molecule
  ENSP ID: ENSP00000389028
MAPPQVLAFGLLLAAATATFAAAQEGEARIGAELWSWAGLGGSGPRPSAPETGIIGRGPRGRAFQRGDRTVRPCSGSGPPRGRKRRGPSRGAASLRSFARLECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAG

SEQ ID NO: 27746 - protein, 342 aa, Homo sapiens; identical to SEQ ID NO: 27744
  Payload ID: 5478
  Gene Symbol: EPCAM
  Gene Name: epithelial cell adhesion molecule
  ENSP ID: ENSP00000410675

SEQ ID NO: 27747 - protein, 883 aa, Homo sapiens
  Payload ID: 5479
  Gene Symbol: ECT2
  Gene Name: epithelial cell transforming 2
  Uniprot ID: Q9H8V3
  ENSP ID: ENSP00000232458
MAENSVLTSTTGRTSLADSSIFDSKVTEISKENLLIGSTSYVEEEMPQIETRVILVQEAGKQEELIKALKDIKVGFVKMESVEEFEGLDSPEFENVFVVTDFQDSVFNDLYKADCRVIGPPVVLNCSQKGEPLPFSCRPLYCTSMMNLVLCFTGFRKKEELVRLVTLVHHMGGVIRKDFNSKVTHLVANCTQGEKFRVAVSLGTPIMKPEWIYKAWERRNEQDFYAAVDDFRNEFKVPPFQDCILSFLGFSDEEKTNMEEMTEMQGGKYLPLGDERCTHLVVEENIVKDLPFEPSKKLYVVKQEWFWGSIQMDARAGETMYLYEKANTPELKKSVSMLSLNTPNSNRKRRRLKETLAQLSRETDVSPFPPRKRPSAEHSLSIGSLLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 27748 - protein, 914 aa, Homo sapiens
  Payload ID: 5479
  Gene Symbol: ECT2
  Gene Name: epithelial cell transforming 2
  Uniprot ID: Q9H8V3
  ENSP ID: ENSP00000376457
MAENSVLTSTTGRTSLADSSIFDSKVTEISKENLLIGSTSYVEEEMPQIETRVILVQEAGKQEELIKALKTIKIMEVPVIKIKESCPGKSDEKLIKSVINMDIKVGFVKMESVEEFEGLDSPEFENVFVVTDFQDSVFNDLYKADCRVIGPPVVLNCSQKGEPLPFSCRPLYCTSMMNLVLCFTGFRKKEELVRLVTLVHHMGGVIRKDFNSKVTHLVANCTQGEKFRVAVSLGTPIMKPEWIYKAWERRNEQDFYAAVDDFRNEFKVPPFQDCILSFLGFSDEEKTNMEEMTEMQGGKYLPLGDERCTHLVVEENIVKDLPFEPSKKLYVVKQEWFWGSIQMDARAGETMYLYEKANTPELKKSVSMLSLNTPNSNRKRRRLKETLAQLSRETDVSPFPPRKRPSAEHSLSIGSLLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 27749 - protein, 150 aa, Homo sapiens
  Payload ID: 5479
  Gene Symbol: ECT2
  Gene Name: epithelial cell transforming 2
  ENSP ID: ENSP00000389108
MAENSVLTSTTGRTSLADSSIFDSKVTEISKENLLIGSTSYVEEEMPQIETRVILVQEAGKQEELIKALKTIKIMEVPVIKIKESCPGKSDEKLIKSVINMDIKVGFVKMESVEEFEGLDSPEFENVFVVTDFQDSVFNDLYKADCRVIG

SEQ ID NO: 27750 - protein, 18 aa, Homo sapiens
  Payload ID: 5479
  Gene Symbol: ECT2
  Gene Name: epithelial cell transforming 2
  ENSP ID: ENSP00000391695
MAENSVLTSTTGRTSLAD

SEQ ID NO: 27751 - protein, 298 aa, Homo sapiens
  Payload ID: 5479
  Gene Symbol: ECT2
  Gene Name: epithelial cell transforming 2
  ENSP ID: ENSP00000397788
  MOD_RES (1)..(1): Any amino acid
XPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAITHSVSTSNVIGFTKHVYVQRLNSTGGRSQYSWFQSVRHSAFRASFSEILEGNTDFSNFKKVLSKSSLTFVKN

SEQ ID NO: 27752 - protein, 110 aa, Homo sapiens
  Payload ID: 5479
  Gene Symbol: ECT2
  Gene Name: epithelial cell transforming 2
  ENSP ID: ENSP00000403446
MAENSVLTSTTGRTSLADSSIFDSKVTEISKENLLIGSTSYVEEEMPQIETRVILVQEAGKQEELIKALKTIKIMEVPVIKIKESCPGKSDEKLIKSVINMDIKVGFVKM

SEQ ID NO: 27753 - protein, 204 aa, Homo sapiens
  Payload ID: 5479
  Gene Symbol: ECT2
  Gene Name: epithelial cell transforming 2
  ENSP ID: ENSP00000403501
MAENSVLTSTTGRTSLADSSIFDSKVTEISKENLLIGSTSYVEEMPQIETRVILVQEAGKQEELIKALKDIKVGFVKMESVEEFEGLDSPEFENVFVVTDFQDSVFNDLYKADCRVIGPPVVLNCSQKGEPLPFSCRPLYCTSMMNLVLCFTGFRKKEELVRLVTLVHHMGGVIRKDFNSKVTHLVANCTQGEKFRVAVSLGTP

SEQ ID NO: 27754 - protein, 209 aa, Homo sapiens
  Payload ID: 5479
  Gene Symbol: ECT2
  Gene Name: epithelial cell transforming 2
  ENSP ID: ENSP00000411674
  MOD_RES (1)..(1): Any amino acid
XYVVKQEWFWGSIQMDARAGETMYLYEKANTPELKKSVSMLSLNTPNSNRKRRRLKETLAQLSRETDVSPFPPHTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEK

SEQ ID NO: 27755 - protein, 159 aa, Homo sapiens
  Payload ID: 5479
  Gene Symbol: ECT2
  Gene Name: epithelial cell transforming 2
  ENSP ID: ENSP00000412028
MAENSVLTSTTGRTSLADSSIFDSKVTEISKENLLIGSTSYVEEEMPQIETRVILVQEAGKQEELIKALKDIKVGFVKMESVEEFEGLDSPEFENVFVVTDFQDSVFNDLYKADCRVIGPPVVLNCSQKGEPLPFSCRPLYCTSMMNLVLCFTGFRKKE

SEQ ID NO: 27756 - protein, 883 aa, Homo sapiens; identical to SEQ ID NO: 27747
  Payload ID: 5479
  Gene Symbol: ECT2
  Gene Name: epithelial cell transforming 2
  Uniprot ID: Q9H8V3
  ENSP ID: ENSP00000412259

SEQ ID NO: 27757 - protein, 106 aa, Homo sapiens
  Payload ID: 5479
  Gene Symbol: ECT2
  Gene Name: epithelial cell transforming 2
  ENSP ID: ENSP00000412331
MAENSVLTSTTGRTSLADSSIFDSKVTEISKENLLIGSTSYVEEEMPQIETRVILVQEAGKQEELIKALKDIKVGFVKMESVEEFEGLDSPEFENVFVVTDFQDSV

SEQ ID NO: 27758 - protein, 882 aa, Homo sapiens
  Payload ID: 5479
  Gene Symbol: ECT2
  Gene Name: epithelial cell transforming 2
  Uniprot ID: Q9H8V3
  ENSP ID: ENSP00000415876
MAENSVLTSTTGRTSLADSSIFDSKVTEISKENLLIGSTSYVEEMPQIETRVILVQEAGKQEELIKALKDIKVGFVKMESVEEFEGLDSPEFENVFVVTDFQDSVFNDLYKADCRVIGPPVVLNCSQKGEPLPFSCRPLYCTSMMNLVLCFTGFRKKEELVRLVTLVHHMGGVIRKDFNSKVTHLVANCTQGEKFRVAVSLGTPIMKPEWIYKAWERRNEQDFYAAVDDFRNEFKVPPFQDCILSFLGFSDEEKTNMEEMTEMQGGKYLPLGDERCTHLVVEENIVKDLPFEPSKKLYVVKQEWFWGSIQMDARAGETMYLYEKANTPELKKSVSMLSLNTPNSNRKRRRLKETLAQLSRETDVSPFPPRKRPSAEHSLSIGSLLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 27759 - protein, 883 aa, Homo sapiens; identical to SEQ ID NO: 27747
  Payload ID: 5479
  Gene Symbol: ECT2
  Gene Name: epithelial cell transforming 2
  Uniprot ID: Q9H8V3
  ENSP ID: ENSP00000443160

SEQ ID NO: 27760 - protein, 904 aa, Homo sapiens
  Payload ID: 5480
  Gene Symbol: ECT2L
  Gene Name: epithelial cell transforming 2 like
  Uniprot ID: Q008S8
  ENSP ID: ENSP00000356655
MESFHTRFSAWTPFSNKSLNRQLFQERVALISHWFDLWTNKQRQEFLFAIFLRCTKSQLRFVQDWFSERMQVAKVDFSTVLPRFISLYIFSFLSPKDLCAAAQVSWPWKFLTEQDCLWMPKCVKFGWFLPYTPTDNEYGAWKRHYIACVSHLDWLTPREAAATYGTLNEPKTEDEELLERQREKCLRKRIWEKIALRKKELFKVRPPWVSGTCCSSVLKPRCQPRLSQTVRERVGLHEALEKQLVLTSLETLPKRSNISGSHSYPLLSKKNWHGVHKNDDRSSYALRPHFMLISSRIPAYEMVMESVKAGVVSVVYEHSVTLESLLYLIEKALDGQKAQSIGIFSDGDSREINLLQGYKIGVKNLLRPEVRDFWEKLGSYVATEEEGGHVDFFVPLGASEAGIEVLSQLSQLTGTFFTAPTGIATGSYQHILSDWLGSQWGKAPSSIYFCESKLQTWSSFTDFLEETLKTVRKQLYPFFKELQKSISGRMIGQFMFDTMGMTNILNNQDTAQALADGLMELSKEDSERNVVEDNSWDTKSRLSKNDLNFEALINLERILQKDSAEKRARVVRELLQSERKYVQILEIVRDVYVAPLKAALSSNRAILSAANIQIIFCDILQILSLNRQFLDNLRDRLQEWGPAHCVGEIVTKFGSQLNTYTNFFNNYPVILKTIEKCREMIPAFRTFLKRHDKTIVTKMLSLPELLLYPSRRFEEYLNLLYAVRLHTPAEHVDRGDLTTAIDQIKKYKGYIDQMKQNITMKDHLSDIQRIIWGCPTLSEVNRYLIRVQDVAQLHCCDEEISFSLRLYEHIHDLSLFLFNDALLVSSRGTSHTPFERTSKTTYQFIASVALHRLLIENIPDSKYVKNAFILQGPKYKWICATEIEDDKFLWLSVLRNAIKSSMEK

SEQ ID NO: 27761 - protein, 77 aa, Homo sapiens
  Payload ID: 5480
  Gene Symbol: ECT2L
  Gene Name: epithelial cell transforming 2 like
  ENSP ID: ENSP00000385187
MESFHTRFSAWTPFSNKSLNRQLFQERVALISHWFDLWTNKQRQEFLFAIFLRCTKSQLRFVQDWFSERMQVAKVDF

SEQ ID NO: 27762 - protein, 904 aa, Homo sapiens; identical to SEQ ID NO: 27760
  Payload ID: 5480
  Gene Symbol: ECT2L
  Gene Name: epithelial cell transforming 2 like
  Uniprot ID: Q008S8
  ENSP ID: ENSP00000387388

SEQ ID NO: 27763 - protein, 904 aa, Homo sapiens; identical to SEQ ID NO: 27760
  Payload ID: 5480
  Gene Symbol: ECT2L
  Gene Name: epithelial cell transforming 2 like
  Uniprot ID: Q008S8
  ENSP ID: ENSP00000442307

SEQ ID NO: 27764 - protein, 157 aa, Homo sapiens
  Payload ID: 5481
  Gene Symbol: EMP1
  Gene Name: epithelial membrane protein 1
  Uniprot ID: P54849
  ENSP ID: ENSP00000256951
MLVLLAGIFVVHIATVIMLFVSTIANVWLVSNTVDASVGLWKNCTNISCSDSLSYASEDALKTVQAFMILSIIFCVIALLVFVFQLFTMEKGNRFFLSGATTLVCWLCILVGVSIYTSHYANRDGTQYHHGYSYILGWICFCFSFIIGVLYLVLRKK

SEQ ID NO: 27765 - protein, 141 aa, Homo sapiens
  Payload ID: 5481
  Gene Symbol: EMP1
  Gene Name: epithelial membrane protein 1
  Uniprot ID: P54849
  ENSP ID: ENSP00000379595
MLVLLAGIFVVHIATVIMLFVSTIANVWLVSNTVDASVGLWKNCTNISCSDSLSYASEDALKTVQAFMILSIIFCVIALLVFVFQLFTMEKGNRFFLSGATTLVCFIMRIVMERSITTAIPTSWAGSASASASSSAFSIWS

SEQ ID NO: 27766 - protein, 90 aa, Homo sapiens
  Payload ID: 5481
  Gene Symbol: EMP1
  Gene Name: epithelial membrane protein 1
  ENSP ID: ENSP00000410755
MILSIIFCVIALLVFVFQLFTMEKGNRFFLSGATTLVCWLCILVGVSIYTSHYANRDGTQYHHGYSYILGWICFCFSFIIGVLYLVLRKK

SEQ ID NO: 27767 - protein, 146 aa, Homo sapiens
  Payload ID: 5481
  Gene Symbol: EMP1
  Gene Name: epithelial membrane protein 1
  ENSP ID: ENSP00000441223
MLVLLAGIFVVHIATVIMLFVSTIANVWLVSNTVDASVGLWKNCTNISCSDSLSYASEDALKTVQAFMILSIIFCVIALLVFVFQLFTMEKGNRFFLSGATTLVCCEYLMGRLQFTLLSPSYHGCFWQLEQISTWFSETSLCNFLL

SEQ ID NO: 27768 - protein, 69 aa, Homo sapiens
  Payload ID: 5481
  Gene Symbol: EMP1
  Gene Name: epithelial membrane protein 1
  ENSP ID: ENSP00000445319
MLVLLAGIFVVHIATVIMLFVSTIANVWLVSNTVDASVGLWKNCTNISCSDSLSYASEDELCHYDFIIT

SEQ ID NO: 27769 - protein, 94 aa, Homo sapiens
  Payload ID: 5481
  Gene Symbol: EMP1
  Gene Name: epithelial membrane protein 1
  ENSP ID: ENSP00000445497
MILSIIFCVIALLVFVFQLFTMEKGNRFFLSGATTLVCCEYLMGRLQFTLLSPSYHGCFWQLEQISTWFSETSLCNFLLWLFVLLWRTLDCCLG

SEQ ID NO: 27770 - protein, 3 aa, Homo sapiens
  Payload ID: 5481
  Gene Symbol: EMP1
  Gene Name: epithelial membrane protein 1
  ENSP ID: ENSP00000445553
MLV

SEQ ID NO: 27771 - protein, 167 aa, Homo sapiens
  Payload ID: 5482
  Gene Symbol: EMP2
  Gene Name: epithelial membrane protein 2
  Uniprot ID: P54851
  ENSP ID: ENSP00000352540
MLVLLAFIIAFHITSAALLFIATVDNAWWVGDEFFADVWRICTNNTNCTVINDSFQEYSTLQAVQATMILSTILCCIAFFIFVLQLFRLKQGERFVLTSIIQLMSCLCVMIAASIYTDRREDIHDKNAKFYPVTREGSYGYSYILAWVAFACTFISGMMYLILRKRK

SEQ ID NO: 27772 - protein, 167 aa, Homo sapiens; identical to SEQ ID NO: 27771
  Payload ID: 5482
  Gene Symbol: EMP2
  Gene Name: epithelial membrane protein 2
  Uniprot ID: P54851
  ENSP ID: ENSP00000445712

SEQ ID NO: 27773 - protein, 163 aa, Homo sapiens
  Payload ID: 5483
  Gene Symbol: EMP3
  Gene Name: epithelial membrane protein 3
  Uniprot ID: P54852
  ENSP ID: ENSP00000270221
MSLLLLVVSALHILILILLFVATLDKSWWTLPGKESLNLWYDCTWNNDTKTWACSNVSENGWLKAVQVLMVLSLILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 27774 - protein, 163 aa, Homo sapiens; identical to SEQ ID NO: 27773
  Payload ID: 5483
  Gene Symbol: EMP3
  Gene Name: epithelial membrane protein 3
  Uniprot ID: P54852
  ENSP ID: ENSP00000469194

SEQ ID NO: 27775 - protein, 161 aa, Homo sapiens
  Payload ID: 5483
  Gene Symbol: EMP3
  Gene Name: epithelial membrane protein 3
  ENSP ID: ENSP00000469275
MSLLLLVVSALHILILILLFVATLDKSWWTLPGKESLNLWLAEGGAGPHGALPHSLLSLLHPVHVPALHHATRRSLLCHRPLPALHQRGGVYWRLDLCHSRRGDPGEAPARGQLRILLRPGLGGLPPRPGQRHHLHPPTEAGVSAPPRSAAPAPSRPPSPR

SEQ ID NO: 27776 - protein, 94 aa, Homo sapiens
  Payload ID: 5483
  Gene Symbol: EMP3
  Gene Name: epithelial membrane protein 3
  ENSP ID: ENSP00000469341
MVLSLILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 27777 - protein, 89 aa, Homo sapiens
  Payload ID: 5483
  Gene Symbol: EMP3
  Gene Name: epithelial membrane protein 3
  ENSP ID: ENSP00000470331
MSLLLLVVSALHILILILLFVATLDKSWWTLPGKESLNLWYDCTWNNDTKTWACSNVSENGWLKAVQVLMVLSLILCCLSFILFMFQLY

SEQ ID NO: 27778 - protein, 63 aa, Homo sapiens
  Payload ID: 5483
  Gene Symbol: EMP3
  Gene Name: epithelial membrane protein 3
  ENSP ID: ENSP00000471592
MSLLLLVVSALHILILILLFVATLDKSWWTLPGKESLNLWYDCTWNNDTKTWACSNVSENGEG

SEQ ID NO: 27779 - protein, 56 aa, Homo sapiens
  Payload ID: 5483
  Gene Symbol: EMP3
  Gene Name: epithelial membrane protein 3
  ENSP ID: ENSP00000471964
MVLSLILCCLSFILFMFQLYTMRRGGLFYATGLCQLCTSVAVFTGALIYAIHAEEI

SEQ ID NO: 27780 - protein, 133 aa, Homo sapiens
  Payload ID: 5484
  Gene Symbol: EPGN
  Gene Name: epithelial mitogen
  Uniprot ID: Q6UW88
  ENSP ID: ENSP00000330375
MALGVPISVYLLFNAMTALTEEAAVTVTPPITAQQADNIEGPIALKFSHLCLEDHNSYCINGACAFHHELEKAICRCFTGYTGERCEHLTLTSYAVDSYEKYIAIGIGVGLLLSGFLVIFYCYIRKRYEKDKI

SEQ ID NO: 27781 - protein, 130 aa, Homo sapiens
  Payload ID: 5484
  Gene Symbol: EPGN
  Gene Name: epithelial mitogen
  ENSP ID: ENSP00000398415
  MOD_RES (1)..(1): Any amino acid
XTALTEEAAVTVTPPITAQQADNIEGPIALKFSHLCLEDHNSYCINGACAFHHELEKAICRCFTGYTGERCEHLTLTSYAVDSYEKYIAIGIGVGLLLSGFLVIFYCYIRKRCLKLKSPYNVCSGERRPL

SEQ ID NO: 27782 - protein, 154 aa, Homo sapiens
  Payload ID: 5484
  Gene Symbol: EPGN
  Gene Name: epithelial mitogen
  Uniprot ID: Q6UW88
  ENSP ID: ENSP00000411898
MALGVPISVYLLFNAMTALTEEAAVTVTPPITAQQGNWTVNKTEADNIEGPIALKFSHLCLEDHNSYCINGACAFHHELEKAICRCFTGYTGERCEHLTLTSYAVDSYEKYIAIGIGVGLLLSGFLVIFYCYIRKRCLKLKSPYNVCSGERRPL

SEQ ID NO: 27783 - protein, 94 aa, Homo sapiens
  Payload ID: 5484
  Gene Symbol: EPGN
  Gene Name: epithelial mitogen
  ENSP ID: ENSP00000423090
MALGVPISVYLLFNAMTALTEEAAVTVTPPITAQQGNWTVNKTEADNIEGPIALKFSHLCLEDHNSYCINGACAFHHELEKAICRCFTGYTGER

SEQ ID NO: 27784 - protein, 94 aa, Homo sapiens
  Payload ID: 5484
  Gene Symbol: EPGN
  Gene Name: epithelial mitogen
  Uniprot ID: Q6UW88
  ENSP ID: ENSP00000424392
MALGVPISVYLLFNAMTALTEEAAVTVTPPITAQQADNIEGPIALKFSHLCLEDHNSYCINGACAFHHELEKAICRCLKLKSPYNVCSGERRPL

SEQ ID NO: 27785 - protein, 112 aa, Homo sapiens
  Payload ID: 5484
  Gene Symbol: EPGN
  Gene Name: epithelial mitogen
  Uniprot ID: Q6UW88
  ENSP ID: ENSP00000425890
MALGVPISVYLLFNAMTALTEEAAVTVTPPITAQQGNWTVNKTEADNIEGPIALKFSHLCLEDHNSYCINGACAFHHELEKAICRCFTGYTGERCLKLKSPYNVCSGERRPL

SEQ ID NO: 27786 - protein, 103 aa, Homo sapiens
  Payload ID: 5484
  Gene Symbol: EPGN
  Gene Name: epithelial mitogen
  Uniprot ID: Q6UW88
  ENSP ID: ENSP00000426550
MALGVPISVYLLFNAMTALTEEAAVTVTPPITAQQADNIEGPIALKFSHLCLEDHNSYCINGACAFHHELEKAICRCFTGYTGERCLKLKSPYNVCSGERRPL

SEQ ID NO: 27787 - protein, 73 aa, Homo sapiens
  Payload ID: 5484
  Gene Symbol: EPGN
  Gene Name: epithelial mitogen
  Uniprot ID: Q6UW88
  ENSP ID: ENSP00000426630
MALGVPISVYLLFNADNIEGPIALKFSHLCLEDHNSYCINGACAFHHELEKAICRCLKLKSPYNVCSGERRPL

SEQ ID NO: 27788 - protein, 103 aa, Homo sapiens
  Payload ID: 5484
  Gene Symbol: EPGN
  Gene Name: epithelial mitogen
  Uniprot ID: Q6UW88
  ENSP ID: ENSP00000426678
MALGVPISVYLLFNAMTALTEEAAVTVTPPITAQQGNWTVNKTEADNIEGPIALKFSHLCLEDHNSYCINGACAFHHELEKAICRCLKLKSPYNVCSGERRPL

SEQ ID NO: 27789 - protein, 677 aa, Homo sapiens
  Payload ID: 5485
  Gene Symbol: ESRP1
  Gene Name: epithelial splicing regulatory protein 1
  Uniprot ID: Q6NXG1
  ENSP ID: ENSP00000351168
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQYATEDGLIHTNDQARTLPKEWVCI

SEQ ID NO: 27790 - protein, 608 aa, Homo sapiens
  Payload ID: 5485
  Gene Symbol: ESRP1
  Gene Name: epithelial splicing regulatory protein 1
  Uniprot ID: Q6NXG1
  ENSP ID: ENSP00000402766
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSV

SEQ ID NO: 27791 - protein, 681 aa, Homo sapiens
  Payload ID: 5485
  Gene Symbol: ESRP1
  Gene Name: epithelial splicing regulatory protein 1
  Uniprot ID: Q6NXG1
  ENSP ID: ENSP00000405738
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQYATEDGLIHTNDQARTLPKEWVCI

SEQ ID NO: 27792 - protein, 659 aa, Homo sapiens
  Payload ID: 5485
  Gene Symbol: ESRP1
  Gene Name: epithelial splicing regulatory protein 1
  Uniprot ID: Q6NXG1
  ENSP ID: ENSP00000407349
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQCLKDVW

SEQ ID NO: 27793 - protein, 94 aa, Homo sapiens
  Payload ID: 5485
  Gene Symbol: ESRP1
  Gene Name: epithelial splicing regulatory protein 1
  ENSP ID: ENSP00000428490
MELIDDNTVVRARGLPWQSSDQDIARFFKGLNIAKGGAALCLNAQGRRNGEALVRFVSEEHRDLALQRHKHHMGTRYIEVYKATGEDFLKIAGG

SEQ ID NO: 27794 - protein, 522 aa, Homo sapiens
  Payload ID: 5485
  Gene Symbol: ESRP1
  Gene Name: epithelial splicing regulatory protein 1
  ENSP ID: ENSP00000429125
EFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQCLKDVW

SEQ ID NO: 27795 - protein, 502 aa, Homo sapiens
  Payload ID: 5485
  Gene Symbol: ESRP1
  Gene Name: epithelial splicing regulatory protein 1
  ENSP ID: ENSP00000430118
  MOD_RES (1)..(1): Any amino acid
XFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSMQPRMDLYTQMTRPGLYPKNGFVFKGPSS

SEQ ID NO: 27796 - protein, 24 aa, Homo sapiens
  Payload ID: 5485
  Gene Symbol: ESRP1
  Gene Name: epithelial splicing regulatory protein 1
  ENSP ID: ENSP00000430207
MTEYLNFEKSSSVSRYGASQVEDM

SEQ ID NO: 27797 - protein, 717 aa, Homo sapiens
  Payload ID: 5486
  Gene Symbol: ESRP2
  Gene Name: epithelial splicing regulatory protein 2
  Uniprot ID: Q9H6T0
  ENSP ID: ENSP00000418748
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQFSQLVNGDVALLGGGPYMLCTDGQQLLRQVLHPEASRKNLVLPDMFFSFYDLRREFHMQHPSTCPARDLTVATMAQGLGLETDATEDDFGVWEVKTMVAVILHLLKEPSSQLFSKPEVIKQKYETGPCSKADVVDSETVVRARGLPWQSSDQDVARFFKGLNVARGGVALCLNAQGRRNGEALIRFVDSEQRDLALQRHKHHMGVRYIEVYKATGEEFVKIAGGTSLEVARFLSREDQVILRLRGLPFSAGPTDVLGFLGPECPVTGGTEGLLFVRHPDGRPTGDAFALFACEELAQAALRRHKGMLGKRYIELFRSTAAEVQQVLNRYASGPLLPTLTAPLLPIPFPLAPGTGRDCVRLRGLPYTATIEDILSFLGEAAADIRPHGVHMVLNQQGRPSGDAFIQMTSAERALAAAQRCHKKVMKERYVEVVPCSTEEMSRVLMGGTLGRSGMSPPPCKLPCLSPPTYTTFQATPTLIPTETAALYPSSALLPAARVPAAPTPVAYYPGPATQLYLNYTAYYPSPPVSPTTVGYLTTPTAALASAPTSVLSQSGALVRMQGVPYTAGMKDLLSVFQAYQLPADDYTSLMPVGDPPRTVLQAPKEWVCL

SEQ ID NO: 27798 - protein, 727 aa, Homo sapiens
  Payload ID: 5486
  Gene Symbol: ESRP2
  Gene Name: epithelial splicing regulatory protein 2
  Uniprot ID: Q9H6T0
  ENSP ID: ENSP00000454554
MTPPPPPPPPPGPDPAADPAADPCPWPGSLVVLFGATAGALGRDLGSDETDLILLVWQVVEPRSRQVGTLHKSLVRAEAAALSTQCREASGLSADSLARAEPLDKVLQQFSQLVNGDVALLGGGPYMLCTDGQQLLRQVLHPEASRKNLVLPDMFFSFYDLRREFHMQHPSTCPARDLTVATMAQGLGLETDATEDDFGVWEVKTMVAVILHLLKEPSSQLFSKPEVIKQKYETGPCSDSTVPCPYSSKADVVDSETVVRARGLPWQSSDQDVARFFKGLNVARGGVALCLNAQGRRNGEALIRFVDSEQRDLALQRHKHHMGVRYIEVYKATGEEFVKIAGGTSLEVARFLSREDQVILRLRGLPFSAGPTDVLGFLGPECPVTGGTEGLLFVRHPDGRPTGDAFALFACEELAQAALRRHKGMLGKRYIELFRSTAAEVQQVLNRYASGPLLPTLTAPLLPIPFPLAPGTGRDCVRLRGLPYTATIEDILSFLGEAAADIRPHGVHMVLNQQGRPSGDAFIQMTSAERALAAAQRCHKKVMKERYVEVVPCSTEEMSRVLMGGTLGRSGMSPPPCKLPCLSPPTYTTFQATPTLIPTETAALYPSSALLPAARVPAAPTPVAYYPGPATQLYLNYTAYYPSPPVSPTTVGYLTTPTAALASAPTSVLSQSGALVRMQGVPYTAGMKDLLSVFQAYQLPADDYTSLMPVGDPPRTVLQAPKEWVCL

SEQ ID NO: 27799 - protein, 43 aa, Homo sapiens
  Payload ID: 5486
  Gene Symbol: ESRP2
  Gene Name: epithelial splicing regulatory protein 2
  ENSP ID: ENSP00000461970
MLCTDGQQLLRQVLHPEASRKNLVLPDMFFSFYDLRREFHMQH

SEQ ID NO: 27800 - protein, 65 aa, Homo sapiens
  Payload ID: 5486
  Gene Symbol: ESRP2
  Gene Name: epithelial splicing regulatory protein 2
  ENSP ID: ENSP00000463237
  MOD_RES (1)..(1): Any amino acid
XQLFSKPEVIKQKYETGPCSKADVVDSETVVRARGLPWQSSDQDVARFFKGLNVARCIKRQGRSL

SEQ ID NO: 27801 - protein, 82 aa, Homo sapiens
  Payload ID: 5486
  Gene Symbol: ESRP2
  Gene Name: epithelial splicing regulatory protein 2
  ENSP ID: ENSP00000463770
MLCTDGQQLLRQVLHPEASRKNLVLPDMFFSFYDLRREFHMQHPSTCPARDLTVATMAQGLGLETDATEDDFGVWEVKTMVA

SEQ ID NO: 27802 - protein, 307 aa, Homo sapiens
  Payload ID: 5487
  Gene Symbol: EPSTI1
  Gene Name: epithelial stromal interaction 1 (breast)
  Uniprot ID: Q96J88
  ENSP ID: ENSP00000318643
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWARSWAYRDSLKAEENRKLQKMKDEQHQKSELLELKRQQQEQERAKIHQTEHRRVNNAFLDRLQGKSQPGGLEQSGGCWNMNSGNSWGI

SEQ ID NO: 27803 - protein, 410 aa, Homo sapiens
  Payload ID: 5487
  Gene Symbol: EPSTI1
  Gene Name: epithelial stromal interaction 1 (breast)
  Uniprot ID: Q96J88
  ENSP ID: ENSP00000318982
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWKLPILPRDHSWARSWAYRDSLKAEENRKLQKMKDEQHQKSELLELKRQQQEQERAKIHQTEHRRVNNAFLDRLQGKSQPGGLEQSGGCWNMNSGNSWGSLLVFSRHLRVYEKILTPIWPSSTDLEKPHEMLFLNVILFSLTVFTLISTAHTLDRAVRSDWLLLVLIYACLEELIPELIFNLYCQGNATLFF

SEQ ID NO: 27804 - protein, 318 aa, Homo sapiens
  Payload ID: 5487
  Gene Symbol: EPSTI1
  Gene Name: epithelial stromal interaction 1 (breast)
  Uniprot ID: Q96J88
  ENSP ID: ENSP00000381746
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWKLPILPRDHSWARSWAYRDSLKAEENRKLQKMKDEQHQKSELLELKRQQQEQERAKIHQTEHRRVNNAFLDRLQGKSQPGGLEQSGGCWNMNSGNSWGI

SEQ ID NO: 27805 - protein, 78 aa, Homo sapiens
  Payload ID: 5487
  Gene Symbol: EPSTI1
  Gene Name: epithelial stromal interaction 1 (breast)
  ENSP ID: ENSP00000442662
MQSKYKQKLKREESVRIKKEAEEAELQKMKAIQREKSNKLEEKKRLQENLRREAFREHQQYKTAEFLSKLNTESPDRS

SEQ ID NO: 27806 - protein, 80 aa, Homo sapiens
  Payload ID: 5487
  Gene Symbol: EPSTI1
  Gene Name: epithelial stromal interaction 1 (breast)
  ENSP ID: ENSP00000444923
MNTRNRVVNSGLGASPASRPTRDPQDPSGRQGELSPVEDQREGLEAAPKGPSRESVVHAGQRRCGAGAGQPGEVEGAEQS

SEQ ID NO: 27807 - protein, 607 aa, Homo sapiens
  Payload ID: 5488
  Gene Symbol: EPM2AIP1
  Gene Name: EPM2A (laforin) interacting protein 1
  Uniprot ID: Q7L775
  ENSP ID: ENSP00000406027
MWMTPKRSKMEVDEALVFRPEWTQRYLVVEPPEGDGALCLVCRRLIVATRERDVRRHYEAEHEYYERYVADGERAALVERLRQGDLPVASFTPEERAARAGLGLCRLLALKGRGWGEGDFVYQCMEVLLREVLPEHVSVLQGVDLSPDITRQRILSIDRNLRNQLFNRARDFKAYSLALDDQAFVAYENYLLVFIRGVGPELEVQEDLLTIINLTHHFSVGALMSAILESLQTAGLSLQRMVGLTTTHTLRMIGENSGLVSYMREKAVSPNCWNVIHYSGFLHLELLSSYDVDVNQIINTISEWIVLIKTRGVRRPEFQTLLTESESEHGERVNGRCLNNWLRRGKTLKLIFSLRKEMEAFLVSVGATTVHFSDKQWLCDFGFLVDIMEHLRELSEELRVSKVFAAAAFDHICTFEVKLNLFQRHIEEKNLTDFPALREVVDELKQQNKEDEKIFDPDRYQMVICRLQKEFERHFKDLRFIKKDLELFSNPFNFKPEYAPISVRVELTKLQANTNLWNEYRIKDLGQFYAGLSAESYPIIKGVACKVASLFDSNQICEKAFSYLTRNQHTLSQPLTDEHLQALFRVATTEMEPGWDDLVRERNESNP

SEQ ID NO: 27808 - protein, 139 aa, Homo sapiens
  Payload ID: 5488
  Gene Symbol: EPM2AIP1
  Gene Name: EPM2A (laforin) interacting protein 1
  ENSP ID: ENSP00000485091
  MOD_RES (1)..(1): Any amino acid
XNCWNVIHYSGFLHLELLSSYDVDVNQIINTISEWIVLIKTRGVRRPEFQTLLTESESEHGERVNGRCLNNWLRRGKTLKLIFSLRKEMEAFLVSVGATTVHFSDKQWLCDFGFLVDIMEHLRELSEELRTQVWPYQKR

SEQ ID NO: 27809 - protein, 42 aa, Homo sapiens
  Payload ID: 5488
  Gene Symbol: EPM2AIP1
  Gene Name: EPM2A (laforin) interacting protein 1
  ENSP ID: ENSP00000485489
  MOD_RES (1)..(1): Any amino acid
XVATRERDVRRHYEAEHEYYERHKFGPIKNDEEKRLHSRIRR

SEQ ID NO: 27810 - protein, 455 aa, Homo sapiens
  Payload ID: 5489
  Gene Symbol: EPHX1
  Gene Name: epoxide hydrolase 1, microsomal (xenobiotic)
  Uniprot ID: P07099
  ENSP ID: ENSP00000272167
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRYPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVGSALNDSPVGLAAYILEKFSTWTNTEFRYLEDGGLERKFSLDDLLTNVMLYWTTGTIISSQRFYKENLGQGWMTQKHERMKVYVPTGFSAFPFELLHTPEKWVRFKYPKLISYSYMVRGGHFAAFEEPELLAQDIRKFLSVLERQ

SEQ ID NO: 27811 - protein, 455 aa, Homo sapiens; identical to SEQ ID NO: 27810
  Payload ID: 5489
  Gene Symbol: EPHX1
  Gene Name: epoxide hydrolase 1, microsomal (xenobiotic)
  Uniprot ID: P07099
  ENSP ID: ENSP00000355802

SEQ ID NO: 27812 - protein, 161 aa, Homo sapiens
  Payload ID: 5489
  Gene Symbol: EPHX1
  Gene Name: epoxide hydrolase 1, microsomal (xenobiotic)
  ENSP ID: ENSP00000398491
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRYPHFKTKIEGLDIHFIHVKPPQLPAGHTPKPLLMVHGWPGSFYEFYKII

SEQ ID NO: 27813 - protein, 136 aa, Homo sapiens
  Payload ID: 5489
  Gene Symbol: EPHX1
  Gene Name: epoxide hydrolase 1, microsomal (xenobiotic)
  ENSP ID: ENSP00000408469
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRYPHFKTKIEGLDIHFIHVKPPQLP

SEQ ID NO: 27814 - protein, 455 aa, Homo sapiens; identical to SEQ ID NO: 27810
  Payload ID: 5489
  Gene Symbol: EPHX1
  Gene Name: epoxide hydrolase 1, microsomal (xenobiotic)
  Uniprot ID: P07099
  ENSP ID: ENSP00000480004

SEQ ID NO: 27815 - protein, 502 aa, Homo sapiens
  Payload ID: 5490
  Gene Symbol: EPHX2
  Gene Name: epoxide hydrolase 2, cytoplasmic
  Uniprot ID: P34913
  ENSP ID: ENSP00000369843
MKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 27816 - protein, 523 aa, Homo sapiens
  Payload ID: 5490
  Gene Symbol: EPHX2
  Gene Name: epoxide hydrolase 2, cytoplasmic
  ENSP ID: ENSP00000427956
MTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 27817 - protein, 312 aa, Homo sapiens
  Payload ID: 5490
  Gene Symbol: EPHX2
  Gene Name: epoxide hydrolase 2, cytoplasmic
  ENSP ID: ENSP00000428191
  MOD_RES (1)..(1): Any amino acid
XTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSELLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVR

SEQ ID NO: 27818 - protein, 372 aa, Homo sapiens
  Payload ID: 5490
  Gene Symbol: EPHX2
  Gene Name: epoxide hydrolase 2, cytoplasmic
  ENSP ID: ENSP00000428875
MTLRAAVFDLDGVLALPAVFGVLGRTEEALALPRGLLNDAFQKGGPEGATTRLMKGEITLSQPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 27819 - protein, 555 aa, Homo sapiens
  Payload ID: 5490
  Gene Symbol: EPHX2
  Gene Name: epoxide hydrolase 2, cytoplasmic
  Uniprot ID: P34913
  ENSP ID: ENSP00000430269
MTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 27820 - protein, 489 aa, Homo sapiens
  Payload ID: 5490
  Gene Symbol: EPHX2
  Gene Name: epoxide hydrolase 2, cytoplasmic
  Uniprot ID: P34913
  ENSP ID: ENSP00000430302
MEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 27821 - protein, 158 aa, Homo sapiens
  Payload ID: 5490
  Gene Symbol: EPHX2
  Gene Name: epoxide hydrolase 2, cytoplasmic
  ENSP ID: ENSP00000430779
MTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGM

SEQ ID NO: 27822 - protein, 360 aa, Homo sapiens
  Payload ID: 5491
  Gene Symbol: EPHX3
  Gene Name: epoxide hydrolase 3
  Uniprot ID: Q9H6B9
  ENSP ID: ENSP00000221730
MPELVVTALLAPSRLSLKLLRAFMWSLVFSVALVAAAVYGCIALTHVLCRPRRGCCGRRRSASPACLSDPSLGEHGFLNLKSSGLRLHYVSAGRGNGPLMLFLHGFPENWFSWRYQLREFQSRFHVVAVDLRGYGPSDAPRDVDCYTIDLLLVDIKDVILGLGYSKCILVAHDWGALLAWHFSIYYPSLVERMVVVSGAPMSVYQDYSLHHISQFFRSHYMFLFQLPWLPEKLLSMSDFQILKTTLTHRKTGIPCLTPSELEAFLYNFSQPGGLTGPLNYYRNLFRNFPLEPQELTTPTLLLWGEKDTYLELGLVEAIGSRFVPGRLEAHILPGIGHWIPQSNPQEMHQYMWAFLQDLLD

SEQ ID NO: 27823 - protein, 360 aa, Homo sapiens; identical to SEQ ID NO: 27822
  Payload ID: 5491
  Gene Symbol: EPHX3
  Gene Name: epoxide hydrolase 3
  Uniprot ID: Q9H6B9
  ENSP ID: ENSP00000410323

SEQ ID NO: 27824 - protein, 125 aa, Homo sapiens
  Payload ID: 5491
  Gene Symbol: EPHX3
  Gene Name: epoxide hydrolase 3
  ENSP ID: ENSP00000468895
MPELVVTALLAPSRLSLKLLRAFMWSLVFSVALVAAAVYGCIALTHVLCRPRRGCCGRRRSASPACLSDPSLGEHGFLNLKSSGLRLHYVSAGRGNGPLMLFLHGFPENWFSWRYQLREFQSRFH

SEQ ID NO: 27825 - protein, 360 aa, Homo sapiens; identical to SEQ ID NO: 27822
  Payload ID: 5491
  Gene Symbol: EPHX3
  Gene Name: epoxide hydrolase 3
  Uniprot ID: Q9H6B9
  ENSP ID: ENSP00000469345

SEQ ID NO: 27826 - protein, 362 aa, Homo sapiens
  Payload ID: 5492
  Gene Symbol: EPHX4
  Gene Name: epoxide hydrolase 4
  Uniprot ID: Q8IUS5
  ENSP ID: ENSP00000359410
MARLRDCLPRLMLTLRSLLFWSLVYCYCGLCASIHLLKLLWSLGKGPAQTFRRPAREHPPACLSDPSLGTHCYVRIKDSGLRFHYVAAGERGKPLMLLLHGFPEFWYSWRYQLREFKSEYRVVALDLRGYGETDAPIHRQNYKLDCLITDIKDILDSLGYSKCVLIGHDWGGMIAWLIAICYPEMVMKLIVINFPHPNVFTEYILRHPAQLLKSSYYYFFQIPWFPEFMFSINDFKVLKHLFTSHSTGIGRKGCQLTTEDLEAYIYVFSQPGALSGPINHYRNIFSCLPLKHHMVTTPTLLLWGENDAFMEVEMAEVTKIYVKNYFRLTILSEASHWLQQDQPDIVNKLIWTFLKEETRKKD

SEQ ID NO: 27827 - protein, 179 aa, Homo sapiens
  Payload ID: 5493
  Gene Symbol: EPPIN-WFDC6
  Gene Name: EPPIN-WFDC6 readthrough
  Uniprot ID: O95925
  ENSP ID: ENSP00000424176
MGSSGLLSLLVLFVLLANVQGPGLTDWLFPRRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKQPCPKIKVECEVEEIDQCTKPRDCPENMKCCPFSRGKKCLDFRKASLST

SEQ ID NO: 27828 - protein, 723 aa, Homo sapiens
  Payload ID: 5494
  Gene Symbol: EPS8L1
  Gene Name: EPS8-like 1
  Uniprot ID: Q8TE68
  ENSP ID: ENSP00000201647
MSTATGPEAAPKPSAKSIYEQRKRYSTVVMADVSQYPVNHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 27829 - protein, 596 aa, Homo sapiens
  Payload ID: 5494
  Gene Symbol: EPS8L1
  Gene Name: EPS8-like 1
  Uniprot ID: Q8TE68
  ENSP ID: ENSP00000245618
MNRTWPRRIWGSSQDEAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 27830 - protein, 659 aa, Homo sapiens
  Payload ID: 5494
  Gene Symbol: EPS8L1
  Gene Name: EPS8-like 1
  ENSP ID: ENSP00000437541
MDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 27831 - protein, 428 aa, Homo sapiens
  Payload ID: 5494
  Gene Symbol: EPS8L1
  Gene Name: EPS8-like 1
  ENSP ID: ENSP00000465830
MHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGWVRW

SEQ ID NO: 27832 - protein, 409 aa, Homo sapiens
  Payload ID: 5494
  Gene Symbol: EPS8L1
  Gene Name: EPS8-like 1
  ENSP ID: ENSP00000466245
MNRTWPRRIWGSSQDEVGFASSVRRPHLTSDAVALLRDNVTPRENELWTSLGDSWTRPGLELSPEEGPPYRPEFFSGWEPPVTDPQSRAWEDPVEKQLQHERRRRQVTQATQQGRGWEVRGRGRSAWPRLTRLSYFLQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 27833 - protein, 548 aa, Homo sapiens
  Payload ID: 5494
  Gene Symbol: EPS8L1
  Gene Name: EPS8-like 1
  ENSP ID: ENSP00000466828
MGRKAIVLAIANTSLAFPLCQHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQVTQATQQGRGWEVRGRGRSAWPRLTRLSYFLQQSAPQVAVNGHRDLEPESEPQLESETAGKWVLCNYDFQARNSSELSVKQRDVLEDKEKVSELEAVMEKQKKKVEGEVEMEVI

SEQ ID NO: 27834 - protein, 715 aa, Homo sapiens
  Payload ID: 5495
  Gene Symbol: EPS8L2
  Gene Name: EPS8-like 2
  Uniprot ID: Q9H6S3
  ENSP ID: ENSP00000320828
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQVNDQSLRLLDIESQEELEDFPLPTVQRSQTVLNQLRYPSVLLLVCQDSEQSKPDVHFFHCDEVEAELVHEDIESALADCRLGKKMRPQTLKGHQEKIRQRQSILPPPQGPAPIPFQHRGGDSPEAKNRVGPQVPLSEPGFRRRESQEEPRAVLAQKIEKETQILNCALDDIEWFVARLQKAAEAFKQLNQRKKGKKKGKKAPAEGVLTLRARPPSEGEFIDCFQKIKLAINLLAKLQKHIQNPSAAELVHFLFGPLDLIVNTCSGPDIARSVSCPLLSRDAVDFLRGHLVPKEMSLWESLGESWMRPRSEWPREPQVPLYVPKFHSGWEPPVDVLQEAPWEVEGLASAPIEEVSPVSRQSIRNSQKHSPTSEPTPPGDALPPVSSPHTHRGYQPTPAMAKYVKILYDFTARNANELSVLKDEVLEVLEDGRQWWKLRSRSGQAGYVPCNILGEARPEDAGAPFEQAGQKYWGPASPTHKLPPSFPGNKDELMQHMDEVNDELIRKISNIRAQPQRHFRVERSQPVSQPLTYESGPDEVRAWLEAKAFSPRIVENLGILTGPQLFSLNKEELKKVCGEEGVRVYSQLTMQKAFLEKQQSGSELEELMNKFHSMNQRRGEDS

SEQ ID NO: 27835 - protein, 95 aa, Homo sapiens
  Payload ID: 5495
  Gene Symbol: EPS8L2
  Gene Name: EPS8-like 2
  ENSP ID: ENSP00000432765
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQ

SEQ ID NO: 27836 - protein, 79 aa, Homo sapiens
  Payload ID: 5495
  Gene Symbol: EPS8L2
  Gene Name: EPS8-like 2
  ENSP ID: ENSP00000432923
MSQSGAVSCCPGATNGSLGRSDGVAKMSPKDLFEQRKKYSNSNVIMHETSQYHVQHLATFIMDKSEAITSVDDAIRKLV

SEQ ID NO: 27837 - protein, 139 aa, Homo sapiens
  Payload ID: 5495
  Gene Symbol: EPS8L2
  Gene Name: EPS8-like 2
  ENSP ID: ENSP00000433057
  MOD_RES (1)..(1): Any amino acid
XQRQSILPPPQGPAPIPFQHRGGDSPEAKNRVGPQVPLSEPGFRRRESQEEPRAVLAQKIEKETQILNCALDDIEWFVARLQKAAEAFKQLNQRKKGKKKGKKAPADRQHLQWPRHRTLRLLPTALPRCRGLPARPPGP

SEQ ID NO: 27838 - protein, 35 aa, Homo sapiens
  Payload ID: 5495
  Gene Symbol: EPS8L2
  Gene Name: EPS8-like 2
  ENSP ID: ENSP00000433173
MSQSGAVSCCPGATNGSLGRSDGVAKMSPKDLFGE

SEQ ID NO: 27839 - protein, 83 aa, Homo sapiens
  Payload ID: 5495
  Gene Symbol: EPS8L2
  Gene Name: EPS8-like 2
  ENSP ID: ENSP00000433223
MSQSGAVSCCPGATNGSLGRSDGVAKMSPKDLFEQRKKYSNSNVIMHETSQYHVQHLATFIMDKSEAITSVDDAIRKLVQLSS

SEQ ID NO: 27840 - protein, 105 aa, Homo sapiens
  Payload ID: 5495
  Gene Symbol: EPS8L2
  Gene Name: EPS8-like 2
  ENSP ID: ENSP00000435128
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQVNDQSLRLLD

SEQ ID NO: 27841 - protein, 715 aa, Homo sapiens; identical to SEQ ID NO: 27834
  Payload ID: 5495
  Gene Symbol: EPS8L2
  Gene Name: EPS8-like 2
  Uniprot ID: Q9H6S3
  ENSP ID: ENSP00000435585

SEQ ID NO: 27842 - protein, 715 aa, Homo sapiens; identical to SEQ ID NO: 27834
  Payload ID: 5495
  Gene Symbol: EPS8L2
  Gene Name: EPS8-like 2
  Uniprot ID: Q9H6S3
  ENSP ID: ENSP00000436035

SEQ ID NO: 27843 - protein, 731 aa, Homo sapiens
  Payload ID: 5495
  Gene Symbol: EPS8L2
  Gene Name: EPS8-like 2
  Uniprot ID: Q9H6S3
  ENSP ID: ENSP00000436230
MSQSGAVSCCPGATNGSLGRSDGVAKMSPKDLFEQRKKYSNSNVIMHETSQYHVQHLATFIMDKSEAITSVDDAIRKLVQLSSKEKIWTQEMLLQVNDQSLRLLDIESQSAQTPGASRVRAMYPQEELEDFPLPTVQRSQTVLNQLRYPSVLLLVCQDSEQSKPDVHFFHCDEVEAELVHEDIESALADCRLGKKMRPQTLKGHQEKIRQRQSILPPPQGPAPIPFQHRGGDSPEAKNRVGPQVPLSEPGFRRRESQEEPRAVLAQKIEKETQILNCALDDIEWFVARLQKAAEAFKQLNQRKKGKKKGKKAPAEGVLTLRARPPSEGEFIDCFQKIKLAINLLAKLQKHIQNPSAAELVHFLFGPLDLIVNTCSGPDIARSVSCPLLSRDAVDFLRGHLVPKEMSLWESLGESWMRPRSEWPREPQVPLYVPKFHSGWEPPVDVLQEAPWEVEGLASAPIEEVSPVSRQSIRNSQKHSPTSEPTPPGDALPPVSSPHTHRGYQPTPAMAKYVKILYDFTARNANELSVLKDEVLEVLEDGRQWWKLRSRSGQAGYVPCNILGEARPEDAGAPFEQAGQKYWGPASPTHKLPPSFPGNKDELMQHMDEVNDELIRKISNIRAQPQRHFRVERSQPVSQPLTYESGPDEVRAWLEAKAFSPRIVENLGILTGPQLFSLNKEELKKVCGEEGVRVYSQLTMQKAFLEKQQSGSELEELMNKFHSMNQRRGEDS

SEQ ID NO: 27844 - protein, 25 aa, Homo sapiens
  Payload ID: 5495
  Gene Symbol: EPS8L2
  Gene Name: EPS8-like 2
  ENSP ID: ENSP00000437085
MSQSGAVSCCPGATNGSLGRSDGVA

SEQ ID NO: 27845 - protein, 167 aa, Homo sapiens
  Payload ID: 5495
  Gene Symbol: EPS8L2
  Gene Name: EPS8-like 2
  ENSP ID: ENSP00000437145
  MOD_RES (1)..(1): Any amino acid
XKIRQRQSILPPPQGPAPIPFQHRGGDSPEAKNRVGPQVPLSEPGFRRRESQEEPRAVLAQKIEKETQILNCALDDIEWFVARLQKAAEAFKQLNQRKKGKKKGKKAPAGKAAEAHPEPQRRGARALPLRASGPDRQHLQWPRHRTLRLLPTALPRCRGLPARPPGP

SEQ ID NO: 27846 - protein, 731 aa, Homo sapiens; identical to SEQ ID NO: 27843
  Payload ID: 5495
  Gene Symbol: EPS8L2
  Gene Name: EPS8-like 2
  Uniprot ID: Q9H6S3
  ENSP ID: ENSP00000480201

SEQ ID NO: 27847 - protein, 232 aa, Homo sapiens [sequence omitted]

SEQ ID NO: 27848 - protein, 563 aa, Homo sapiens
  Payload ID: 5496
  Gene Symbol: EPS8L3
  Gene Name: EPS8-like 3
  Uniprot ID: Q8TE67
  ENSP ID: ENSP00000354551
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 27849 - protein, 593 aa, Homo sapiens
  Payload ID: 5496
  Gene Symbol: EPS8L3
  Gene Name: EPS8-like 3
  Uniprot ID: Q8TE67
  ENSP ID: ENSP00000355255
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 27850 - protein, 594 aa, Homo sapiens
  Payload ID: 5496
  Gene Symbol: EPS8L3
  Gene Name: EPS8-like 3
  Uniprot ID: Q8TE67
  ENSP ID: ENSP00000358820
MSRPSSRAIYLHRKEYSQNLTSEPTLLQHRVEHLMTCKQGSQRVQGPEDALQKLFEMDAQGRVWSQDLILQVRDGWLQLLDIETKEELDSYRLDSIQAMNVALNTCSYNSILSITVQEPGLPGTSTLLFQCQEVGAERLKTSLQKALEEELEQSRPRLGGLQPGQDRWRGPAMERPLPMEQARYLEPGIPPEQPHQRTLEHSLPPSPRPLPRHTSAREPSAFTLPPPRRSSSPEDPERDEEVLNHVLRDIELFMGKLEKAQAKTSRKKKFGKKNKDQGGLTQAQYIDCFQKIKHSFNLLGRLATWLKETSAPELVHILFKSLNFILARCPEAGLAAQVISPLLTPKAINLLQSCLSPPESNLWMGLGPAWTTSRADWTGDEPLPYQPTFSDDWQLPEPSSQAPLGYQDPVSLRRGSHRLGSTSHFPQEKTHNHDPQPGDPNSRPSSPKPAQPALKMQVLYEFEARNPRELTVVQGEKLEVLDHSKRWWLVKNEAGRSGYIPSNILEPLQPGTPGTQGQSPSRVPMLRLSSRPEEVTDWLQAENFSTATVRTLGSLTGSQLLRIRPGELQMLCPQEAPRILSRLEAVRRMLGISP

SEQ ID NO: 27851 - protein, 39 aa, Homo sapiens
  Payload ID: 5496
  Gene Symbol: EPS8L3
  Gene Name: EPS8-like 3
  ENSP ID: ENSP00000483789
MSRPSSRAIYLHRKEYSQNLTSEPTLLQHRVEHACGPPL

SEQ ID NO: 27852 - protein, 550 aa, Homo sapiens
  Payload ID: 5497
  Gene Symbol: EPN1
  Gene Name: epsin 1
  Uniprot ID: Q9Y6I3
  ENSP ID: ENSP00000085079
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 27853 - protein, 576 aa, Homo sapiens
  Payload ID: 5497
  Gene Symbol: EPN1
  Gene Name: epsin 1
  Uniprot ID: Q9Y6I3
  ENSP ID: ENSP00000270460
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQPPSCGPEDDAQLQLALSLSREEHDKEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 27854 - protein, 662 aa, Homo sapiens
  Payload ID: 5497
  Gene Symbol: EPN1
  Gene Name: epsin 1
  Uniprot ID: Q9Y6I3
  ENSP ID: ENSP00000406209
MGDQSWLWNQAAPGVRSPVFACSVEKGNVPLVLSEHLAHSRDPGSGAVRFLISPEPWASAILGTSGLLASPVLPAALDAVTCQHLPQPSSGSRPISPRIGALCPLLLQPGTMSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 27855 - protein, 60 aa, Homo sapiens
  Payload ID: 5497
  Gene Symbol: EPN1
  Gene Name: epsin 1
  ENSP ID: ENSP00000466593
  MOD_RES (1)..(1): Any amino acid
XKPSTNGTTAAGGFDTEPDEFSDFDRLRTALPTSGSSAAYWTRLPPGFYSLNSYRSCFIR

SEQ ID NO: 27856 - protein, 584 aa, Homo sapiens
  Payload ID: 5498
  Gene Symbol: EPN2
  Gene Name: epsin 2
  Uniprot ID: O95208
  ENSP ID: ENSP00000261495
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSTSPRVSSELEQARPQTSGEEELQLQLALAMSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGAPATSAPVNPFQVNQPQPLTLNQLRGSPVLGTSTSFGPGPGVESMAVASMTSAAPQPALGATGSSLTPLGPAMMNMVGSVGIPPSAAQATGTTNPFLL

SEQ ID NO: 27857 - protein, 641 aa, Homo sapiens
  Payload ID: 5498
  Gene Symbol: EPN2
  Gene Name: epsin 2
  Uniprot ID: O95208
  ENSP ID: ENSP00000320543
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSPEASLCPQHRTGAPLGQSEELQPLSQRHPFLPHLGLASRPNGDWSQPCLTCDRAARATSPRVSSELEQARPQTSGEEELQLQLALAMSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGAPATSAPVNPFQVNQPQPLTLNQLRGSPVLGTSTSFGPGPGVESMAVASMTSAAPQPALGATGSSLTPLGPAMMNMVGSVGIPPSAAQATGTTNPFLL

SEQ ID NO: 27858 - protein, 356 aa, Homo sapiens
  Payload ID: 5498
  Gene Symbol: EPN2
  Gene Name: epsin 2
  Uniprot ID: O95208
  ENSP ID: ENSP00000378980
MSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGAPATSAPVNPFQVNQPQPLTLNQLRGSPVLGTSTSFGPGPGVESMAVASMTSAAPQPALGATGSSLTPLGPAMMNMVGSVGIPPSAAQATGTTNPFLL

SEQ ID NO: 27859 - protein, 584 aa, Homo sapiens; identical to SEQ ID NO: 27856
  Payload ID: 5498
  Gene Symbol: EPN2
  Gene Name: epsin 2
  Uniprot ID: O95208
  ENSP ID: ENSP00000378982

SEQ ID NO: 27860 - protein, 484 aa, Homo sapiens
  Payload ID: 5498
  Gene Symbol: EPN2
  Gene Name: epsin 2
  ENSP ID: ENSP00000378988
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSPEASLCPQHRTGAPLGQSEELQPLSQRHPFLPHLGLASRPNGDWSQPCLTCDRAARATSPRVSSELEQARPQTSGEEELQLQLALAMSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTGMQGLTGLLFTMEI

SEQ ID NO: 27861 - protein, 409 aa, Homo sapiens
  Payload ID: 5498
  Gene Symbol: EPN2
  Gene Name: epsin 2
  ENSP ID: ENSP00000378990
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSTSPRVSSELEQARPQTSGEEELQLQLALAMSREVAEQEERLRRGDDLRLQMALEESRRDTVKIPKKKEHGSLPQQTTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRT

SEQ ID NO: 27862 - protein, 577 aa, Homo sapiens
  Payload ID: 5498
  Gene Symbol: EPN2
  Gene Name: epsin 2
  ENSP ID: ENSP00000459542
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQCRENIFAIQTLKDFQYIDRDGKDQGINVREKSKQLVALLKDEERLKAERAQALKTKERMAQVATGMGSNQITFGRGSSQPNLSTSHSEQEYGKAGGSPASYHGSTSPRVSSELEQARPQTSGEEELQLQLALAMSREVAEQEERLRRGDDLRLQMALEESRRDTVKIPKKKETTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGAPATSAPVNPFQVNQPQPLTLNQLRGSPVLGTSTSFGPGPGVESMAVASMTSAAPQPALGATGSSLTPLGPAMMNMVGSVGIPPSAAQATGTTNPFLL

SEQ ID NO: 27863 - protein, 349 aa, Homo sapiens
  Payload ID: 5498
  Gene Symbol: EPN2
  Gene Name: epsin 2
  ENSP ID: ENSP00000459678
MSREVAEQEERLRRGDDLRLQMALEESRRDTVKIPKKKETTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAPGAPATSAPVNPFQVNQPQPLTLNQLRGSPVLGTSTSFGPGPGVESMAVASMTSAAPQPALGATGSSLTPLGPAMMNMVGSVGIPPSAAQATGTTNPFLL

SEQ ID NO: 27864 - protein, 251 aa, Homo sapiens
  Payload ID: 5498
  Gene Symbol: EPN2
  Gene Name: epsin 2
  ENSP ID: ENSP00000460193
MSREVAEQEERLRRGDDLRLQMALEESRRDTVKIPKKKEQTTLLDLMDALPSSGPAAQKAEPWGPSASTNQTNPWGGPAAPASTSDPWPSFGTKPAASIDPWGVPTGATVQSVPKNSDPWAASQQPASSAGKRASDAWGAVSTTKPVSVSGSFELFSNLNGTIKDDFSEFDNLRTSKKTAESVTSLPSQNNGTTSPDPFESQPLTVASSKPSSARKTPESFLGPNAALVNLDSLVTRPAPPAQSLNPFLAP

SEQ ID NO: 27865 - protein, 62 aa, Homo sapiens
  Payload ID: 5498
  Gene Symbol: EPN2
  Gene Name: epsin 2
  ENSP ID: ENSP00000462392
MTTSSIRRQMKNIVNNYSEAEIKVREATSNDPWGPSSSLMTEIADLTYNVVAFSEIMSMVWK

SEQ ID NO: 27866 - protein, 75 aa, Homo sapiens
  Payload ID: 5498
  Gene Symbol: EPN2
  Gene Name: epsin 2
  ENSP ID: ENSP00000462426
MTTSSIRRQMKNIVNNYSEAEIKVREATSNDPWGPSSSLMTEIADLTYNVVAFSEIMSMVWKRLNDHGKNWRHVY

SEQ ID NO: 27867 - protein, 32 aa, Homo sapiens
  Payload ID: 5498
  Gene Symbol: EPN2
  Gene Name: epsin 2
  ENSP ID: ENSP00000462465
MTTSSIRRQMKNIVNNYSEAEIKVREATSNDP

SEQ ID NO: 27868 - protein, 20 aa, Homo sapiens
  Payload ID: 5498
  Gene Symbol: EPN2
  Gene Name: epsin 2
  ENSP ID: ENSP00000462606
MTTSSIRRQMKNIVNNYSEA

SEQ ID NO: 27869 - protein, 38 aa, Homo sapiens
  Payload ID: 5498
  Gene Symbol: EPN2
  Gene Name: epsin 2
  ENSP ID: ENSP00000462958
MTTSSIRRQMKNIVNNYSEAEIKVREATSNDPWGPSSS

SEQ ID NO: 27870 - protein, 22 aa, Homo sapiens
  Payload ID: 5498
  Gene Symbol: EPN2
  Gene Name: epsin 2
  ENSP ID: ENSP00000463141
MTTSSIRRQMKNIVNNYSEAEI

SEQ ID NO: 27871 - protein, 95 aa, Homo sapiens
  Payload ID: 5498
  Gene Symbol: EPN2
  Gene Name: epsin 2
  ENSP ID: ENSP00000463627
MTTSSIRRQMKNIVNNYSEAEIKVREATSNDPWGPSSSLMTEIADLTYNVVAFSEIMSMVWKRLNDHGKNWRHVYKALTLLDYLIKTGSERVAQQ

SEQ ID NO: 27872 - protein, 36 aa, Homo sapiens
  Payload ID: 5498
  Gene Symbol: EPN2
  Gene Name: epsin 2
  ENSP ID: ENSP00000463769
MTSDYRWPWKKAEGTQLKFQKRKSMALSHSRLRCWI

SEQ ID NO: 27873 - protein, 632 aa, Homo sapiens
  Payload ID: 5499
  Gene Symbol: EPN3
  Gene Name: epsin 3
  Uniprot ID: Q9H201
  ENSP ID: ENSP00000268933
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGFSRRYGEDYSRSRGSPSSYNSSSSSPRYTSDLEQARPQTSGEEELQLQLALAMSREEAEKPVPPASHRDEDLQLQLALRLSRQEHEKEVRSWQGDGSPMANGAGAVVHHQRDREPEREERKEEEKLKTSQSSILDLADIFVPALAPPSTHCSADPWDIPGFRPNTEASGSSWGPSADPWSPIPSGTVLSRSQPWDLTPMLSSSEPWGRTPVLPAGPPTTDPWALNSPHHKLPSTGADPWGASLETSDTPGGASTFDPFAKPPESTETKEGLEQALPSGKPSSPVELDLFGDPSPSSKQNGTKEPDALDLGILGEALTQPSKEARACRTPESFLGPSASSLVNLDSLVKAPQVAKTRNPFLTGLSAPSPTNPFGAGEPGRPTLNQMRTGSPALGLAGGPVGAPLGSMTYSASLPLPLSSVPAGLTLPASVSVFPQAGAFAPQPLLPTPSSAGPRPPPPQTGTNPFL

SEQ ID NO: 27874 - protein, 136 aa, Homo sapiens
  Payload ID: 5499
  Gene Symbol: EPN3
  Gene Name: epsin 3
  ENSP ID: ENSP00000421515
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKD

SEQ ID NO: 27875 - protein, 208 aa, Homo sapiens
  Payload ID: 5499
  Gene Symbol: EPN3
  Gene Name: epsin 3
  Uniprot ID: Q9H201
  ENSP ID: ENSP00000421933
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGFSRRYGEDYSRSRGSPSSYNCPASDVRGRGTAAAAGPRHEP

SEQ ID NO: 27876 - protein, 50 aa, Homo sapiens
  Payload ID: 5499
  Gene Symbol: EPN3
  Gene Name: epsin 3
  ENSP ID: ENSP00000421936
MTTSALRRQVKNIVHNYSEAEIKWPSPKSWACCGGGSMTAARTGGTCTRL

SEQ ID NO: 27877 - protein, 50 aa, Homo sapiens; identical to SEQ ID NO: 27876
  Payload ID: 5499
  Gene Symbol: EPN3
  Gene Name: epsin 3
  ENSP ID: ENSP00000422201

SEQ ID NO: 27878 - protein, 108 aa, Homo sapiens
  Payload ID: 5499
  Gene Symbol: EPN3
  Gene Name: epsin 3
  ENSP ID: ENSP00000422601
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKD

SEQ ID NO: 27879 - protein, 51 aa, Homo sapiens
  Payload ID: 5499
  Gene Symbol: EPN3
  Gene Name: epsin 3
  ENSP ID: ENSP00000422682
MTTSALRRQVKNIVHNYSEAEIKVREATSNDPWGPPSSLMSEIADLTFNTV

SEQ ID NO: 27880 - protein, 11 aa, Homo sapiens
  Payload ID: 5499
  Gene Symbol: EPN3
  Gene Name: epsin 3
  ENSP ID: ENSP00000424306
MTTSALRRQVK

SEQ ID NO: 27881 - protein, 17 aa, Homo sapiens
  Payload ID: 5499
  Gene Symbol: EPN3
  Gene Name: epsin 3
  ENSP ID: ENSP00000426676
MSEIADLTFNTVAFTEV

SEQ ID NO: 27882 - protein, 168 aa, Homo sapiens
  Payload ID: 5499
  Gene Symbol: EPN3
  Gene Name: epsin 3
  ENSP ID: ENSP00000426762
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGF

SEQ ID NO: 27883 - protein, 318 aa, Homo sapiens
  Payload ID: 5499
  Gene Symbol: EPN3
  Gene Name: epsin 3
  ENSP ID: ENSP00000439512
MTTSALRRQVKNIVHNYSEAEIKVREATSNDPWGPPSSLMSEIADLTFNTVAFTEVMGMLWRRLNDSGKNWRHVYKALTLLDYLLKTGSERVAHQCRENLYTIQTLKDFQYIDRDGKDQGVNVREKVKQVMALLKDEERLRQERTHALKTKERMALEGIGIGSGQLGFSRRYGEDYSRSRGSPSSYNSSSSSPRYTSDLEQARPQTSGEEELQLQLALAMSREEAEKPVPPASHRDEDLQLQLALRLSRQEHEKEVRSWQGDGSPMANGAGAVVHHQRDREPEREERKEEEKLKTSQAPPTSEPRLPLPSTVLHPGLG

SEQ ID NO: 27884 - protein, 318 aa, Homo sapiens; identical to SEQ ID NO: 27883
  Payload ID: 5499
  Gene Symbol: EPN3
  Gene Name: epsin 3
  ENSP ID: ENSP00000460911

SEQ ID NO: 27885 - protein, 229 aa, Homo sapiens
  Payload ID: 5500
  Gene Symbol: EBI3
  Gene Name: Epstein-Barr virus induced 3
  Uniprot ID: Q14213
  ENSP ID: ENSP00000221847
MTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 27886 - protein, 127 aa, Homo sapiens
  Payload ID: 5501
  Gene Symbol: EQTN
  Gene Name: equatorin, sperm acrosome associated
  Uniprot ID: Q9NQ60
  ENSP ID: ENSP00000369370
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQSI

SEQ ID NO: 27887 - protein, 294 aa, Homo sapiens
  Payload ID: 5501
  Gene Symbol: EQTN
  Gene Name: equatorin, sperm acrosome associated
  Uniprot ID: Q9NQ60
  ENSP ID: ENSP00000369371
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQRSTPNVPAFWTMLAKAINGTAVVMDDKDQLFHPIPESDVNATQGENQPDLEDLKIKIMLGISLMTLLLFVVLLAFCSATLYKLRHLSYKSCESQYSVNPELATMSYFHPSEGVSDTSFSKSAESSTFLGTTSSDMRRSGTRTSESKIMTDIISIGSDNEMHENDESVTR

SEQ ID NO: 27888 - protein, 265 aa, Homo sapiens
  Payload ID: 5501
  Gene Symbol: EQTN
  Gene Name: equatorin, sperm acrosome associated
  Uniprot ID: Q9NQ60
  ENSP ID: ENSP00000441630
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNGSTPNVPAFWTMLAKAINGTAVVMDDKDQLFHPIPESDVNATQGENQPDLEDLKIKIMLGISLMTLLLFVVLLAFCSATLYKLRHLSYKSCESQYSVNPELATMSYFHPSEGVSDTSFSKSAESSTFLGTTSSDMRRSGTRTSESKIMTDIISIGSDNEMHENDESVTR

SEQ ID NO: 27889 - protein, 657 aa, Homo sapiens
  Payload ID: 5502
  Gene Symbol: EDEM1
  Gene Name: ER degradation enhancer, mannosidase alpha-like 1
  Uniprot ID: Q92611
  ENSP ID: ENSP00000256497
MQWRALVLGLVLLRLGLHGVLWLVFGLGPSMGFYQRFPLSFGFQRLRSPDGPASPTSGPVGRPGGVSGPSWLQPPGTGAAQSPRKAPRRPGPGMCGPANWGYVLGGRGRGPDEYEKRYSGAFPPQLRAQMRDLARGMFVFGYDNYMAHAFPQDELNPIHCRGRGPDRGDPSNLNINDVLGNYSLTLVDALDTLAIMGNSSEFQKAVKLVINTVSFDKDSTVQVFEATIRVLGSLLSAHRIITDSKQPFGDMTIKDYDNELLYMAHDLAVRLLPAFENTKTGIPYPRVNLKTGVPPDTNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQNYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSTEDRMESFFLSETCKYLYLLFDEDNPVHKSGTRYMFTTEGHIVSVDEHLRELPWKEFFSEEGGQDQGGKSVHRPKPHELKVINSSSNCNRVPDERRYSLPLKSIYMRQIDQMVGLI

SEQ ID NO: 27890 - protein, 78 aa, Homo sapiens
  Payload ID: 5502
  Gene Symbol: EDEM1
  Gene Name: ER degradation enhancer, mannosidase alpha-like 1
  ENSP ID: ENSP00000393659
MRDLARGMFVFGYDNYMAHAFPQDELNPIHCRGRGPDRGDPSNLNINDVLGNYSLTLVDALDTLAGPGKPPFCSQNNN

SEQ ID NO: 27891 - protein, 376 aa, Homo sapiens
  Payload ID: 5502
  Gene Symbol: EDEM1
  Gene Name: ER degradation enhancer, mannosidase alpha-like 1
  Uniprot ID: Q92611
  ENSP ID: ENSP00000394099
MGNSSEFQKAVKLVINTVSFDKDSTVQVFEATIRVLGSLLSAHRIITDSKQPFGDMTIKDYDNELLYMAHDLAVRLLPAFENTKTGIPYPRVNLKTGVPPDTNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQNYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSTEDRMESFFLSETCKYLYLVCVLQDEPRNI

SEQ ID NO: 27892 - protein, 53 aa, Homo sapiens
  Payload ID: 5502
  Gene Symbol: EDEM1
  Gene Name: ER degradation enhancer, mannosidase alpha-like 1
  ENSP ID: ENSP00000394615
MPAAPARPCNGERSSWGWCSSGLASMEYCGSSSGWGPAWASTSAFRSASASSV

SEQ ID NO: 27893 - protein, 541 aa, Homo sapiens
  Payload ID: 5503
  Gene Symbol: EDEM2
  Gene Name: ER degradation enhancer, mannosidase alpha-like 2
  Uniprot ID: Q9BV94
  ENSP ID: ENSP00000363615
MPFRLLIPLGLLCALLPQHHGAPGPDGSAPDPAHYSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 27894 - protein, 578 aa, Homo sapiens
  Payload ID: 5503
  Gene Symbol: EDEM2
  Gene Name: ER degradation enhancer, mannosidase alpha-like 2
  Uniprot ID: Q9BV94
  ENSP ID: ENSP00000363616
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 27895 - protein, 932 aa, Homo sapiens
  Payload ID: 5504
  Gene Symbol: EDEM3
  Gene Name: ER degradation enhancer, mannosidase alpha-like 3
  Uniprot ID: Q9BZQ6
  ENSP ID: ENSP00000318147
MSEAGGRGCGSPVPQRARWRLVAATAAFCLVSATSVWTAGAEPMSREEKQKLGNQVLEMFDHAYGNYMEHAYPADELMPLTCRGRVRGQEPSRGDVDDALGKFSLTLIDSLDTLVVLNKTKEFEDAVRKVLRDVNLDNDVVVSVFETNIRVLGGLLGGHSLAIMLKEKGEYMQWYNDELLQMAKQLGYKLLPAFNTTSGLPYPRINLKFGIRKPEARTGTETDTCTACAGTLILEFAALSRFTGATIFEEYARKALDFLWEKRQRSSNLVGVTINIHTGDWVRKDSGVGAGIDSYYEYLLKAYVLLGDDSFLERFNTHYDAIMRYISQPPLLLDVHIHKPMLNARTWMDALLAFFPGLQVLKGDIRPAIETHEMLYQVIKKHNFLPEAFTTDFRVHWAQHPLRPEFAESTYFLYKATGDPYYLEVGKTLIENLNKYARVPCGFAAMKDVRTGSHEDRMDSFFLAEMFKYLYLLFADKEDIIFDIEDYIFTTEAHLLPLWLSTTNQSISKKNTTSEYTELDDSNFDWTCPNTQILFPNDPLYAQSIREPLKNVVDKSCPRGIIRVEESFRSGAKPPLRARDFMATNPEHLEILKKMGVSLIHLKDGRVQLVQHAIQAASSIDAEDGLRFMQEMIELSSQQQKEQQLPPRAVQIVSHPFFGRVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRDPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 27896 - protein, 905 aa, Homo sapiens
  Payload ID: 5504
  Gene Symbol: EDEM3
  Gene Name: ER degradation enhancer, mannosidase alpha-like 3
  Uniprot ID: Q9BZQ6
  ENSP ID: ENSP00000356482
MSREEKQKLGNQVLEMFDHAYGNYMEHAYPADELMPLTCRGRVRGQEPSRGDVDDALGKFSLTLIDSLDTLVVLNKTKEFEDAVRKVLRDVNLDNDVVVSVFETNIRVLGGLLGGHSLAIMLKEKGEYMQWYNDELLQMAKQLGYKLLPAFNTTSGLPYPRINLKFGIRKPEARTGTETDTCTACAGTLILEFAALSRFTGATIFEEYARKALDFLWEKRQRSSNLVGVTINIHTGDWVRKDSGVGAGIDSYYEYLLKAYVLLGDDSFLERFNTHYDAIMRYISQPPLLLDVHIHKPMLNARTWMDALLAFFPGLQVLKGDIRPAIETHEMLYQVIKKHNFLPEAFTTDFRVHWAQHPLRPEFAESTYFLYKATGDPYYLEVGKTLIENLNKYARVPCGFAAMKDVRTGSHEDRMDSFFLAEMFKYLYLLFADKEDIIFDIEDYIFTTEAHLLPLWLSTTNQSISKKNTTSEYTELDDSNFDWTCPNTQILFPNDPLYAQSIREPLKNVVDKSCPRGIIRVEESFRSGAKPPLRARDFMATNPEHLEILKKMGVSLIHLKDGRVQLVQHAIQAASSIDAEDGLRFMQEMIELSSQQQKEQQLPPRAVQIVSHPFFGRVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRAAILKGKMIPSYIINSNPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 27897 - protein, 380 aa, Homo sapiens
  Payload ID: 5504
  Gene Symbol: EDEM3
  Gene Name: ER degradation enhancer, mannosidase alpha-like 3
  ENSP ID: ENSP00000390536
VDKSCPRGIIRVEESFRSGAKPPLRARDFMATNPEHLEILKKMGVSLIHLKDGRVQLVQHAIQAASSIDAEDGLRFMQEMIELSSQQQKEQQLPPRAVQIVSHPFFGRVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRDPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 27898 - protein, 275 aa, Homo sapiens
  Payload ID: 5505
  Gene Symbol: ERLIN1
  Gene Name: ER lipid raft associated 1
  ENSP ID: ENSP00000359436
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNK

SEQ ID NO: 27899 - protein, 348 aa, Homo sapiens
  Payload ID: 5505
  Gene Symbol: ERLIN1
  Gene Name: ER lipid raft associated 1
  Uniprot ID: O75477
  ENSP ID: ENSP00000384900
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 27900 - protein, 348 aa, Homo sapiens; identical to SEQ ID NO: 27899
  Payload ID: 5505
  Gene Symbol: ERLIN1
  Gene Name: ER lipid raft associated 1
  Uniprot ID: O75477
  ENSP ID: ENSP00000410964

SEQ ID NO: 27901 - protein, 339 aa, Homo sapiens
  Payload ID: 5506
  Gene Symbol: ERLIN2
  Gene Name: ER lipid raft associated 2
  Uniprot ID: O94905
  ENSP ID: ENSP00000276461
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEKKISEIEDAAFLAREKAKADAECYTAMKIAEANKLKLTPEYLQLMKYKAIASNSKIYFGKDIPNMFMDSAGSVSKQFEGLADKLSFGLEDEPLETATKEN

SEQ ID NO: 27902 - protein, 152 aa, Homo sapiens
  Payload ID: 5506
  Gene Symbol: ERLIN2
  Gene Name: ER lipid raft associated 2
  Uniprot ID: O94905
  ENSP ID: ENSP00000335220
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFGLENDFSQESS

SEQ ID NO: 27903 - protein, 152 aa, Homo sapiens; identical to SEQ ID NO: 27902
  Payload ID: 5506
  Gene Symbol: ERLIN2
  Gene Name: ER lipid raft associated 2
  Uniprot ID: O94905
  ENSP ID: ENSP00000380405

SEQ ID NO: 27904 - protein, 206 aa, Homo sapiens
  Payload ID: 5506
  Gene Symbol: ERLIN2
  Gene Name: ER lipid raft associated 2
  Uniprot ID: O94905
  ENSP ID: ENSP00000427847
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFGKKVSPEHAVLKQGSWNPASLHCLKPGCLQGVMVTYGQEMLKNLVLRSWSQRSSWRMLIAMQQDP

SEQ ID NO: 27905 - protein, 339 aa, Homo sapiens; identical to SEQ ID NO: 27901
  Payload ID: 5506
  Gene Symbol: ERLIN2
  Gene Name: ER lipid raft associated 2
  Uniprot ID: O94905
  ENSP ID: ENSP00000428112

SEQ ID NO: 27906 - protein, 197 aa, Homo sapiens
  Payload ID: 5506
  Gene Symbol: ERLIN2
  Gene Name: ER lipid raft associated 2
  ENSP ID: ENSP00000429229
MAQLGAVVAVASSFFCASLFSAVHKIEEGHIGVYYSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEK

SEQ ID NO: 27907 - protein, 338 aa, Homo sapiens
  Payload ID: 5506
  Gene Symbol: ERLIN2
  Gene Name: ER lipid raft associated 2
  ENSP ID: ENSP00000429621
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEKKISEIEDAAFLAREKAKADAECYTAMKIAEANKLKLTPEYLQLMKYKAIASNSKIYFGKDIPNMFMDSAGSVSKQFEGLADKLSFGLEDEPLETATKE

SEQ ID NO: 27908 - protein, 206 aa, Homo sapiens; identical to SEQ ID NO: 27904
  Payload ID: 5506
  Gene Symbol: ERLIN2
  Gene Name: ER lipid raft associated 2
  Uniprot ID: O94905
  ENSP ID: ENSP00000429903

SEQ ID NO: 27909 - protein, 206 aa, Homo sapiens; identical to SEQ ID NO: 27904
  Payload ID: 5506
  Gene Symbol: ERLIN2
  Gene Name: ER lipid raft associated 2
  Uniprot ID: O94905
  ENSP ID: ENSP00000473292

SEQ ID NO: 27910 - protein, 75 aa, Homo sapiens
  Payload ID: 5507
  Gene Symbol: EMC1
  Gene Name: ER membrane protein complex subunit 1
  ENSP ID: ENSP00000364329
MAAEWASRFWLWATLLIPAAAVYEDQVGKFDWRQQYVGKVKFASLEFSPGSKKLVVATEKNVIAALNSRTGEICE

SEQ ID NO: 27911 - protein, 992 aa, Homo sapiens
  Payload ID: 5507
  Gene Symbol: EMC1
  Gene Name: ER membrane protein complex subunit 1
  Uniprot ID: Q8N766
  ENSP ID: ENSP00000364345
MAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 27912 - protein, 971 aa, Homo sapiens
  Payload ID: 5507
  Gene Symbol: EMC1
  Gene Name: ER membrane protein complex subunit 1
  Uniprot ID: Q8N766
  ENSP ID: ENSP00000364354
MAAEWASRFWLWATLLIPAAAVYEDQVGKFDWRQQYVGKVKFASLEFSPGSKKLVVATEKNVIAALNSRTGEIYVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 27913 - protein, 86 aa, Homo sapiens
  Payload ID: 5507
  Gene Symbol: EMC1
  Gene Name: ER membrane protein complex subunit 1
  ENSP ID: ENSP00000417070
  MOD_RES (1)..(1): Any amino acid
XNATAFSSLDRPQLPQVLQQSYIFPSSISAMEATITERGITSRHLLIGLPSGAILSLPKALLDPRRPEIPTEQSRCTDTRRAIHQL

SEQ ID NO: 27914 - protein, 75 aa, Homo sapiens; identical to SEQ ID NO: 27910
  Payload ID: 5507
  Gene Symbol: EMC1
  Gene Name: ER membrane protein complex subunit 1
  ENSP ID: ENSP00000418481

SEQ ID NO: 27915 - protein, 178 aa, Homo sapiens
  Payload ID: 5507
  Gene Symbol: EMC1
  Gene Name: ER membrane protein complex subunit 1
  ENSP ID: ENSP00000419345
FIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLSFAGSPPPRDPNRTKQMYRYTQSDSSTITRQFLECEVSTQLPRVWSPLVWLWPMVWTFTKLESTHPSSLTF

SEQ ID NO: 27916 - protein, 993 aa, Homo sapiens
  Payload ID: 5507
  Gene Symbol: EMC1
  Gene Name: ER membrane protein complex subunit 1
  Uniprot ID: Q8N766
  ENSP ID: ENSP00000420608
MAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 27917 - protein, 262 aa, Homo sapiens
  Payload ID: 5508
  Gene Symbol: EMC10
  Gene Name: ER membrane protein complex subunit 10
  Uniprot ID: Q5UCC4
  ENSP ID: ENSP00000334037
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGR

SEQ ID NO: 27918 - protein, 254 aa, Homo sapiens
  Payload ID: 5508
  Gene Symbol: EMC10
  Gene Name: ER membrane protein complex subunit 10
  Uniprot ID: Q5UCC4
  ENSP ID: ENSP00000366117
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWHIILGGAVLLTALRPAAPGPAPPPQEA

SEQ ID NO: 27919 - protein, 42 aa, Homo sapiens
  Payload ID: 5508
  Gene Symbol: EMC10
  Gene Name: ER membrane protein complex subunit 10
  ENSP ID: ENSP00000470164
MAAASAGATRLLLLLLMAVAAPSRARGSGCRAGTGARGVSAL

SEQ ID NO: 27920 - protein, 43 aa, Homo sapiens
  Payload ID: 5508
  Gene Symbol: EMC10
  Gene Name: ER membrane protein complex subunit 10
  ENSP ID: ENSP00000470949
MAAASAGATRLLLLLLMAHSFEIDDSANFRKRGSLLWNQQDGT

SEQ ID NO: 27921 - protein, 88 aa, Homo sapiens
  Payload ID: 5508
  Gene Symbol: EMC10
  Gene Name: ER membrane protein complex subunit 10
  ENSP ID: ENSP00000471764
MLVIPALREAEAGGPLEVRSSRPACSKWLGRKVERARPVARWGCCWSTHLRSMTVPTSGSGAHCSGTSRMVPCPCHSGSSARRSGADS

SEQ ID NO: 27922 - protein, 371 aa, Homo sapiens
  Payload ID: 5508
  Gene Symbol: EMC10
  Gene Name: ER membrane protein complex subunit 10
  ENSP ID: ENSP00000472420
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGRPLSSAFCWQRSSWTGAFGTAAGVSCARLPHGPMQPQGLPPCPWSRARDPGHYASSDLASPYPEPMQSGNMPPSLQPLCLCSRWSHPPVPGWARWSCPGSCSAPLTLTLD

SEQ ID NO: 27923 - protein, 42 aa, Homo sapiens; identical to SEQ ID NO: 27919
  Payload ID: 5508
  Gene Symbol: EMC10
  Gene Name: ER membrane protein complex subunit 10
  ENSP ID: ENSP00000472714

SEQ ID NO: 27924 - protein, 297 aa, Homo sapiens
  Payload ID: 5509
  Gene Symbol: EMC2
  Gene Name: ER membrane protein complex subunit 2
  Uniprot ID: Q15006
  ENSP ID: ENSP00000220853
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYAKAAFCLEELMMTNPHNHLYCQQYAEVKYTQGGLENLELSRKYFAQALKLNNRNMRALFGLYMSASHIASNPKASAKTKKDNMKYASWAASQINRAYQFAGRSKKETKYSLKAVEDMLETLQITQS

SEQ ID NO: 27925 - protein, 135 aa, Homo sapiens
  Payload ID: 5509
  Gene Symbol: EMC2
  Gene Name: ER membrane protein complex subunit 2
  ENSP ID: ENSP00000428040
  MOD_RES (1)..(1): Any amino acid
XIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDLQVEVRRKPNILLRLSK

SEQ ID NO: 27926 - protein, 112 aa, Homo sapiens
  Payload ID: 5509
  Gene Symbol: EMC2
  Gene Name: ER membrane protein complex subunit 2
  ENSP ID: ENSP00000430122
MKYSSSHTLYCLKEEMRDKMRKWREENSRNSEQIVEVGEELINEYASKLGDDIWIIYEQVMIAALDYGRDDLALFCLQELRRQFPGSHRVKRLTGMRFEAMERYDDAIQLYD

SEQ ID NO: 27927 - protein, 261 aa, Homo sapiens
  Payload ID: 5510
  Gene Symbol: EMC3
  Gene Name: ER membrane protein complex subunit 3
  Uniprot ID: Q9P0I2
  ENSP ID: ENSP00000245046
MAGPELLLDSNIRLWVVLPIVIITFFVGMIRHYVSILLQSDKKLTQEQVSDSQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKTEWEALELTDHQWALDDVEEELMAKDLHFEGMFKKELQTSIF

SEQ ID NO: 27928 - protein, 203 aa, Homo sapiens
  Payload ID: 5510
  Gene Symbol: EMC3
  Gene Name: ER membrane protein complex subunit 3
  ENSP ID: ENSP00000408803
MAGPELLLDSNIRLWVVLPIVIITFFVGMIRHYVSILLQSDKKLTQEQVSDRKYLSGLVQWLTPIIPALWGAEMGGSLEPRNLRPTLAACQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASW

SEQ ID NO: 27929 - protein, 78 aa, Homo sapiens
  Payload ID: 5510
  Gene Symbol: EMC3
  Gene Name: ER membrane protein complex subunit 3
  ENSP ID: ENSP00000474771
MAGPELLLDSNIRLWVVLPIVIITFFVGMIRHYVSILLQSDKKLTQEQVSDSQVLIRSRVLRENGKYIPKQSFLTRKY

SEQ ID NO: 27930 - protein, 149 aa, Homo sapiens
  Payload ID: 5511
  Gene Symbol: EMC4
  Gene Name: ER membrane protein complex subunit 4
  Uniprot ID: Q5J8M3
  ENSP ID: ENSP00000249209
MTAQGGLVANRGRRFKWAIELSGPGGGSRGRSDRGSGQGDSLYPVGYLDKQVPDTSVQETDRILVEKRCWDIALGPLKQIPMNLFIMYMAGNTISIFPTMMVCMMAWRPIQALMAISAKNGVQWWRTAFVNMRKQRLVPMYLGLIYILL

SEQ ID NO: 27931 - protein, 183 aa, Homo sapiens
  Payload ID: 5511
  Gene Symbol: EMC4
  Gene Name: ER membrane protein complex subunit 4
  Uniprot ID: Q5J8M3
  ENSP ID: ENSP00000267750
MTAQGGLVANRGRRFKWAIELSGPGGGSRGRSDRGSGQGDSLYPVGYLDKQVPDTSVQETDRILVEKRCWDIALGPLKQIPMNLFIMYMAGNTISIFPTMMVCMMAWRPIQALMAISATFKMLESSSQKFLQGLVYLIGNLMGLALAVYKCQSMGLLPTHASDWLAFIEPPERMEFSGGGLLL

SEQ ID NO: 27932 - protein, 78 aa, Homo sapiens
  Payload ID: 5511
  Gene Symbol: EMC4
  Gene Name: ER membrane protein complex subunit 4
  ENSP ID: ENSP00000452672
MTAQGGLVANRGRRFKWAIELSGPGGGSRGRSDRGSGQGDSLYPVGYLDKQVPDTSVQETDRILVEKRMEFSGGGLLL

SEQ ID NO: 27933 - protein, 98 aa, Homo sapiens
  Payload ID: 5511
  Gene Symbol: EMC4
  Gene Name: ER membrane protein complex subunit 4
  ENSP ID: ENSP00000452849
  MOD_RES (1)..(1): Any amino acid
XCWDIALGPLKQIPMNLFIMYMAGNTISIFPTMMVCMMAWRPIQALMAISANVRKFKPEVSSGFGLSHWEPDGFGIGCLQVPVHGTVTYTCIGLVSLH

SEQ ID NO: 27934 - protein, 125 aa, Homo sapiens
  Payload ID: 5511
  Gene Symbol: EMC4
  Gene Name: ER membrane protein complex subunit 4
  ENSP ID: ENSP00000453287
MTAQGGLVANRGRRFKWAIELSGPGGGSSFLVWFFRGRSDRGSGQGDSLYPVGYLDKQVPDTSVQETDRILVEKRCWDIALGPLKQIPMNLFIMYMAGNTISIFPTMMVCMMAWRPIQALMAISA

SEQ ID NO: 27935 - protein, 72 aa, Homo sapiens
  Payload ID: 5511
  Gene Symbol: EMC4
  Gene Name: ER membrane protein complex subunit 4
  ENSP ID: ENSP00000453610
MTAQGGLVANRGRRFKWAIELSGPGGGSRETRSTQSVTWTSKCLIPACKRQTGSWWRSAAGTSPWVPSNRFP

SEQ ID NO: 27936 - protein, 43 aa, Homo sapiens
  Payload ID: 5511
  Gene Symbol: EMC4
  Gene Name: ER membrane protein complex subunit 4
  ENSP ID: ENSP00000453880
MTAQGGLVANRGRRFKWAIELSGPGGGSSAAGTSPWVPSNRFP

SEQ ID NO: 27937 - protein, 84 aa, Homo sapiens
  Payload ID: 5511
  Gene Symbol: EMC4
  Gene Name: ER membrane protein complex subunit 4
  ENSP ID: ENSP00000454042
MTAQGGLVANRGRRFKWAIELSGPGGGSRGRSDRGSGQGDSLYPVGYLDKQVPDTSVQETDRILVEKVQSAAGTSPWVPSNRFP

SEQ ID NO: 27938 - protein, 102 aa, Homo sapiens
  Payload ID: 5511
  Gene Symbol: EMC4
  Gene Name: ER membrane protein complex subunit 4
  ENSP ID: ENSP00000454052
MTAQGGLVANRGRRFKWAIELSGPGGGSRGRSDRGSGQGDSLYPVGYLDKQVPDTSVQETDRILVEKRCWDIALGPLKQIPMNLFIMYMAGNTISIFPTMMA

SEQ ID NO: 27939 - protein, 72 aa, Homo sapiens
  Payload ID: 5511
  Gene Symbol: EMC4
  Gene Name: ER membrane protein complex subunit 4
  ENSP ID: ENSP00000473881
MTAQGGLVANRGRRFKWAIELSGPGGGSRGRSDRGSGQGDSLYPVGYLDKQVPDTSVQETDRILVEKVQRLQ

SEQ ID NO: 27940 - protein, 110 aa, Homo sapiens
  Payload ID: 5512
  Gene Symbol: EMC6
  Gene Name: ER membrane protein complex subunit 6
  Uniprot ID: Q9BV81
  ENSP ID: ENSP00000248378
MAAVVAKREGPPFISEAAVRGNAAVLDYCRTSVSALSGATAGILGLTGLYGFIFYLLASVLLSLLLILKAGRRWNKYFKSRRPLFTGGLIGGLFTYVLFWTFLYGMVHVY

SEQ ID NO: 27941 - protein, 110 aa, Homo sapiens; identical to SEQ ID NO: 27940
  Payload ID: 5512
  Gene Symbol: EMC6
  Gene Name: ER membrane protein complex subunit 6
  Uniprot ID: Q9BV81
  ENSP ID: ENSP00000380322

SEQ ID NO: 27942 - protein, 242 aa, Homo sapiens
  Payload ID: 5513
  Gene Symbol: EMC7
  Gene Name: ER membrane protein complex subunit 7
  Uniprot ID: Q9NPA0
  ENSP ID: ENSP00000256545
MAAALWGFFPVLLLLLLSGDVQSSEVPGAAAEGSGGSGVGIGDRFKIEGRAVVPGVKPQDWISAARVLVDGEEHVGFLKTDGSFVVHDIPSGSYVVEVVSPAYRFDPVRVDITSKGKMRARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 27943 - protein, 192 aa, Homo sapiens
  Payload ID: 5513
  Gene Symbol: EMC7
  Gene Name: ER membrane protein complex subunit 7
  ENSP ID: ENSP00000434292
  MOD_RES (1)..(1): Any amino acid
XLLLLLLSGDVQSSEVPGAAAEGSGGSGVGIGDRFKIEGRAVVPGVKPQDWISAARVLVDGEEHVGFLKARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 27944 - protein, 160 aa, Homo sapiens
  Payload ID: 5513
  Gene Symbol: EMC7
  Gene Name: ER membrane protein complex subunit 7
  ENSP ID: ENSP00000434496
MSRARRTDGSFVVHDIPSGSYVVEVVSPAYRFDPVRVDITSKGKMRARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKT

SEQ ID NO: 27945 - protein, 210 aa, Homo sapiens
  Payload ID: 5514
  Gene Symbol: EMC8
  Gene Name: ER membrane protein complex subunit 8
  Uniprot ID: O43402
  ENSP ID: ENSP00000253457
MPGVKLTTQAYCKMVLHGAKYPHCAVNGLLVAEKQKPRKEHLPLGGPGAHHTLFVDCIPLFHGTLALAPMLEVALTLIDSWCKDHSYVIAGYYQANERVKDASPNQVAEKVASRIAEGFSDTALIMVDNTKFTMDCVAPTIHVYEHHENRWRCRDPHHDYCEDWPEAQRISASLLDSRSYETLVDFDNHLDDIRNDWTNPEINKAVLHLC

SEQ ID NO: 27946 - protein, 126 aa, Homo sapiens
  Payload ID: 5514
  Gene Symbol: EMC8
  Gene Name: ER membrane protein complex subunit 8
  Uniprot ID: O43402
  ENSP ID: ENSP00000391730
MPGVKLTTQAYCKMVLHGAKYPHCAVNGLLVAEKQKPRKEHLPLGGPGAHHTLFVDCIPLFHGTLALAPMLEVALTLIDSWCKDHSYVIAGYYQANERVKDASPNQVAEKVASRIAEGFSDTALIM

SEQ ID NO: 27947 - protein, 100 aa, Homo sapiens
  Payload ID: 5514
  Gene Symbol: EMC8
  Gene Name: ER membrane protein complex subunit 8
  ENSP ID: ENSP00000471751
VASRIAEGFSDTALIMVDNTKFTMDCVAPTIHVYEHHENRWRCRDPHHDYCEDWPEAQRISASLLDSRSYETLVDFDNHLDDIRNDWTNPEINKAVLHLC

SEQ ID NO: 27948 - protein, 208 aa, Homo sapiens
  Payload ID: 5515
  Gene Symbol: EMC9
  Gene Name: ER membrane protein complex subunit 9
  Uniprot ID: Q9Y3B6
  ENSP ID: ENSP00000216799
MGEVEISALAYVKMCLHAARYPHAAVNGLFLAPAPRSGECLCLTDCVPLFHSHLALSVMLEVALNQVDVWGAQAGLVVAGYYHANAAVNDQSPGPLALKIAGRIAEFFPDAVLIMLDNQKLVPQPRVPPVIVLENQGLRWVPKDKNLVMWRDWEESRQMVGALLEDRAHQHLVDFDCHLDDIRQDWTNQRLNTQITQWVGPTNGNGNA

SEQ ID NO: 27949 - protein, 208 aa, Homo sapiens; identical to SEQ ID NO: 27948
  Payload ID: 5515
  Gene Symbol: EMC9
  Gene Name: ER membrane protein complex subunit 9
  Uniprot ID: Q9Y3B6
  ENSP ID: ENSP00000403210

SEQ ID NO: 27950 - protein, 94 aa, Homo sapiens
  Payload ID: 5515
  Gene Symbol: EMC9
  Gene Name: ER membrane protein complex subunit 9
  ENSP ID: ENSP00000452797
MGEVEISALAYVKMCLHAARYPHAAVNGLFLAPAPRSGECLCLTDCVPLFHSHLALSVMLEVALNQVDVWGAQAGLVVAGYYHANAAVNDQSNI

SEQ ID NO: 27951 - protein, 134 aa, Homo sapiens
  Payload ID: 5515
  Gene Symbol: EMC9
  Gene Name: ER membrane protein complex subunit 9
  ENSP ID: ENSP00000454016
MGFAHSWLLTPLIFPLHSPGPLALKIAGRIAEFFPDAVLIMLDNQKLVPQPRVPPVIVLENQGLRWVPKDKNLVMWRDWEESRQMVGALLEDRAHQHLVDFDCHLDDIRQDWTNQRLNTQITQWVGPTNGNGNA

SEQ ID NO: 27952 - protein, 631 aa, Homo sapiens
  Payload ID: 5516
  Gene Symbol: ERMARD
  Gene Name: ER membrane-associated RNA degradation
  Uniprot ID: Q5T6L9
  ENSP ID: ENSP00000355734
MEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETPTSDTPLALAPRKPQPCRCRRRVRPSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 27953 - protein, 678 aa, Homo sapiens
  Payload ID: 5516
  Gene Symbol: ERMARD
  Gene Name: ER membrane-associated RNA degradation
  Uniprot ID: Q5T6L9
  ENSP ID: ENSP00000355735
MEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETWPQLLRELCSTPVPTLFCPRIVLEVLVVLRSISEQCRRVSSQVTVASELRHRQWVERTLRSRQRQNYLRMWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 27954 - protein, 552 aa, Homo sapiens
  Payload ID: 5516
  Gene Symbol: ERMARD
  Gene Name: ER membrane-associated RNA degradation
  Uniprot ID: Q5T6L9
  ENSP ID: ENSP00000375945
MKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETWPQLLRELCSTPVPTLFCPRIVLEVLVVLRSISEQCRRVSSQVTVASELRHRQWVERTLRSRQRQNYLRMWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 27955 - protein, 605 aa, Homo sapiens
  Payload ID: 5516
  Gene Symbol: ERMARD
  Gene Name: ER membrane-associated RNA degradation
  Uniprot ID: Q5T6L9
  ENSP ID: ENSP00000397661
MEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 27956 - protein, 46 aa, Homo sapiens
  Payload ID: 5516
  Gene Symbol: ERMARD
  Gene Name: ER membrane-associated RNA degradation
  ENSP ID: ENSP00000466335
  MOD_RES (1)..(1): Any amino acid
XVYDIICNLGFQLRENCDINSIVTQNGEVCWKTITDCVSYTESVIS

SEQ ID NO: 27957 - protein, 74 aa, Homo sapiens
  Payload ID: 5516
  Gene Symbol: ERMARD
  Gene Name: ER membrane-associated RNA degradation
  ENSP ID: ENSP00000466474
MKLTSCLERALGDVFLLIGKECPFLLRDLLSSEELAQVFSQSVMNVLKVFVGSPCGLNLRNVLWHGFASPEEIP

SEQ ID NO: 27958 - protein, 28 aa, Homo sapiens
  Payload ID: 5516
  Gene Symbol: ERMARD
  Gene Name: ER membrane-associated RNA degradation
  ENSP ID: ENSP00000466679
MKLTSCLERALGDVFLLIGKECPFLLRD

SEQ ID NO: 27959 - protein, 73 aa, Homo sapiens
  Payload ID: 5516
  Gene Symbol: ERMARD
  Gene Name: ER membrane-associated RNA degradation
  ENSP ID: ENSP00000467582
MEVLIGDPITTCLSPSVYDIICNLGFQLRENCDINSIVTQNGEVCWKTITDCVSYTESGSGLLGKREAAGPCV

SEQ ID NO: 27960 - protein, 5 aa, Homo sapiens
  Payload ID: 5516
  Gene Symbol: ERMARD
  Gene Name: ER membrane-associated RNA degradation
  ENSP ID: ENSP00000467665
MKLTS

SEQ ID NO: 27961 - protein, 174 aa, Homo sapiens
  Payload ID: 5516
  Gene Symbol: ERMARD
  Gene Name: ER membrane-associated RNA degradation
  ENSP ID: ENSP00000468124
MEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPEVFLLIGKECPFLLRDLLSSEELAQVFSQSVMNVLKVFVGSPCGLNLRNVLWHGFASPEEIPPKYCSMMI

SEQ ID NO: 27962 - protein, 542 aa, Homo sapiens
  Payload ID: 5516
  Gene Symbol: ERMARD
  Gene Name: ER membrane-associated RNA degradation
  ENSP ID: ENSP00000468240
MKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAEILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETWPQLLRELCSTPVPTLFCPRIVLEVLVVLRSISEQCRRVSSQVTVASELRHRQWVERTLRSRQRQNYLRMWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 27963 - protein, 18 aa, Homo sapiens
  Payload ID: 5516
  Gene Symbol: ERMARD
  Gene Name: ER membrane-associated RNA degradation
  ENSP ID: ENSP00000468722
MKLTSCLERALGDVFLLI

SEQ ID NO: 27964 - protein, 552 aa, Homo sapiens; identical to SEQ ID NO: 27954
  Payload ID: 5516
  Gene Symbol: ERMARD
  Gene Name: ER membrane-associated RNA degradation
  Uniprot ID: Q5T6L9
  ENSP ID: ENSP00000480327

SEQ ID NO: 27965 - protein, 631 aa, Homo sapiens; identical to SEQ ID NO: 27952
  Payload ID: 5516
  Gene Symbol: ERMARD
  Gene Name: ER membrane-associated RNA degradation
  Uniprot ID: Q5T6L9
  ENSP ID: ENSP00000483666

SEQ ID NO: 27966 - protein, 605 aa, Homo sapiens; identical to SEQ ID NO: 27955
  Payload ID: 5516
  Gene Symbol: ERMARD
  Gene Name: ER membrane-associated RNA degradation
  Uniprot ID: Q5T6L9
  ENSP ID: ENSP00000483849

SEQ ID NO: 27967 - protein, 678 aa, Homo sapiens; identical to SEQ ID NO: 27953
  Payload ID: 5516
  Gene Symbol: ERMARD
  Gene Name: ER membrane-associated RNA degradation
  Uniprot ID: Q5T6L9
  ENSP ID: ENSP00000483960

SEQ ID NO: 27968 - protein, 28 aa, Homo sapiens
  Payload ID: 5516
  Gene Symbol: ERMARD
  Gene Name: ER membrane-associated RNA degradation
  ENSP ID: ENSP00000485754
MKLTSCLERALGDVFLLIGKECPFLLRD

SEQ ID NO: 27969 - protein, 73 aa, Homo sapiens; identical to SEQ ID NO: 27959
  Payload ID: 5516
  Gene Symbol: ERMARD
  Gene Name: ER membrane-associated RNA degradation
  ENSP ID: ENSP00000486172

SEQ ID NO: 27970 - protein, 542 aa, Homo sapiens; identical to SEQ ID NO: 27962
  Payload ID: 5516
  Gene Symbol: ERMARD
  Gene Name: ER membrane-associated RNA degradation
  ENSP ID: ENSP00000486399

SEQ ID NO: 27971 - protein, 174 aa, Homo sapiens; identical to SEQ ID NO: 27961
  Payload ID: 5516
  Gene Symbol: ERMARD
  Gene Name: ER membrane-associated RNA degradation
  ENSP ID: ENSP00000486419

SEQ ID NO: 27972 - protein, 5 aa, Homo sapiens
  Payload ID: 5516
  Gene Symbol: ERMARD
  Gene Name: ER membrane-associated RNA degradation
  ENSP ID: ENSP00000486806
MKLTS

SEQ ID NO: 27973 - protein, 74 aa, Homo sapiens; identical to SEQ ID NO: 27957
  Payload ID: 5516
  Gene Symbol: ERMARD
  Gene Name: ER membrane-associated RNA degradation
  ENSP ID: ENSP00000486852

SEQ ID NO: 27974 - protein, 46 aa, Homo sapiens; identical to SEQ ID NO: 27956
  Payload ID: 5516
  Gene Symbol: ERMARD
  Gene Name: ER membrane-associated RNA degradation
  ENSP ID: ENSP00000486998
  MOD_RES (1)..(1): Any amino acid

SEQ ID NO: 27975 - protein, 18 aa, Homo sapiens
  Payload ID: 5516
  Gene Symbol: ERMARD
  Gene Name: ER membrane-associated RNA degradation
  ENSP ID: ENSP00000487161
MKLTSCLERALGDVFLLI

SEQ ID NO: 27976 - protein, 437 aa, Homo sapiens
  Payload ID: 5517
  Gene Symbol: ERAL1
  Gene Name: Era-like 12S mitochondrial rRNA chaperone 1
  Uniprot ID: O75616
  ENSP ID: ENSP00000254928
MAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKGHVISQIAQEAGHDLMDIFLCDVDIRLSVKLLK

SEQ ID NO: 27977 - protein, 171 aa, Homo sapiens
  Payload ID: 5517
  Gene Symbol: ERAL1
  Gene Name: Era-like 12S mitochondrial rRNA chaperone 1
  ENSP ID: ENSP00000396125
MAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVVGTYKGSP

SEQ ID NO: 27978 - protein, 284 aa, Homo sapiens
  Payload ID: 5517
  Gene Symbol: ERAL1
  Gene Name: Era-like 12S mitochondrial rRNA chaperone 1
  ENSP ID: ENSP00000464402
  MOD_RES (1)..(1): Any amino acid
XSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKQYLLTQAQPGPWEYHSAVLTSQTPEEICANIIREKLLEHLPQEVPYNVQQ

SEQ ID NO: 27979 - protein, 276 aa, Homo sapiens
  Payload ID: 5517
  Gene Symbol: ERAL1
  Gene Name: Era-like 12S mitochondrial rRNA chaperone 1
  ENSP ID: ENSP00000464607
  MOD_RES (1)..(1): Any amino acid
XAAPSWRGARLVQSVLRVWQVGPHVARERVIPFSSLLGFQRRCVSCVAGSAFSGPRLASASRSNGQGSALDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEAIPSDTGPARALGVPQCSPH

SEQ ID NO: 27980 - protein, 80 aa, Homo sapiens
  Payload ID: 5517
  Gene Symbol: ERAL1
  Gene Name: Era-like 12S mitochondrial rRNA chaperone 1
  ENSP ID: ENSP00000467860
QPGPWEYHSAVLTSQTPEEICANIIREKLLEHLPQEVPYNVQQKTAVWEEGPGGELVIQQKLLVPKESYVGIPAQAAGRN

SEQ ID NO: 27981 - protein, 462 aa, Homo sapiens
  Payload ID: 5518
  Gene Symbol: ERRFI1
  Gene Name: ERBB receptor feedback inhibitor 1
  Uniprot ID: Q9UJM3
  ENSP ID: ENSP00000366702
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFREAEETNGGAQIQPLPADCGISSATEKPDSKTKMDLGGHVKRKHLSYVVSP

SEQ ID NO: 27982 - protein, 79 aa, Homo sapiens
  Payload ID: 5518
  Gene Symbol: ERRFI1
  Gene Name: ERBB receptor feedback inhibitor 1
  ENSP ID: ENSP00000465100
MSIAGVAAQEIRVPLKTGFLHNGRAMGNMRKTYWSSRSEFKNNFLNIDPITMAYSLNSSAQERLIPLGMYSENLITVSI

SEQ ID NO: 27983 - protein, 74 aa, Homo sapiens
  Payload ID: 5518
  Gene Symbol: ERRFI1
  Gene Name: ERBB receptor feedback inhibitor 1
  ENSP ID: ENSP00000466454
MSIAGVAAQEIRVPLKTGFLHNGRAMGNMRKTYWSSRSEFKKACFQICSDEWPLLCRKWSISKVQLAPSSYSPK

SEQ ID NO: 27984 - protein, 53 aa, Homo sapiens
  Payload ID: 5518
  Gene Symbol: ERRFI1
  Gene Name: ERBB receptor feedback inhibitor 1
  ENSP ID: ENSP00000466958
MSIAGVAAQEIRVPLKTGFLHNGRAMGNMRKTYWSSRSEFKNTGRKLPGTVGD

SEQ ID NO: 27985 - protein, 52 aa, Homo sapiens
  Payload ID: 5518
  Gene Symbol: ERRFI1
  Gene Name: ERBB receptor feedback inhibitor 1
  ENSP ID: ENSP00000467030
MSIAGVAAQEIRVPLKTGFLHNGRAMGNMRKTYWSSRSEFKNFLSFQQLFKY

SEQ ID NO: 27986 - protein, 1412 aa, Homo sapiens
  Payload ID: 5519
  Gene Symbol: ERBB2IP
  Gene Name: erbb2 interacting protein
  Uniprot ID: Q96RT1
  ENSP ID: ENSP00000284037
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKKHPQTSSSGDPCQDGIFISGQQNYSSATLSHKDVPPDSLMKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27987 - protein, 1302 aa, Homo sapiens
  Payload ID: 5519
  Gene Symbol: ERBB2IP
  Gene Name: erbb2 interacting protein
  Uniprot ID: Q96RT1
  ENSP ID: ENSP00000370322
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27988 - protein, 1346 aa, Homo sapiens
  Payload ID: 5519
  Gene Symbol: ERBB2IP
  Gene Name: erbb2 interacting protein
  Uniprot ID: Q96RT1
  ENSP ID: ENSP00000370325
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDANGYSFINIEHGQAVSLLKTFQNTVELIIVREVSS

SEQ ID NO: 27989 - protein, 1371 aa, Homo sapiens
  Payload ID: 5519
  Gene Symbol: ERBB2IP
  Gene Name: erbb2 interacting protein
  Uniprot ID: Q96RT1
  ENSP ID: ENSP00000370330
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27990 - protein, 610 aa, Homo sapiens
  Payload ID: 5519
  Gene Symbol: ERBB2IP
  Gene Name: erbb2 interacting protein
  ENSP ID: ENSP00000397833
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSMLSRSFNSNFTTVSSFHCGSSRDLHGSQGSLALSVADRRGSGGHIFRMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27991 - protein, 1302 aa, Homo sapiens; identical to SEQ ID NO: 27987
  Payload ID: 5519
  Gene Symbol: ERBB2IP
  Gene Name: erbb2 interacting protein
  Uniprot ID: Q96RT1
  ENSP ID: ENSP00000422015

SEQ ID NO: 27992 - protein, 1367 aa, Homo sapiens
  Payload ID: 5519
  Gene Symbol: ERBB2IP
  Gene Name: erbb2 interacting protein
  Uniprot ID: Q96RT1
  ENSP ID: ENSP00000422766
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27993 - protein, 158 aa, Homo sapiens
  Payload ID: 5519
  Gene Symbol: ERBB2IP
  Gene Name: erbb2 interacting protein
  ENSP ID: ENSP00000423959
SMLSRSFNSNFTTVSSFHCGSSRDLHGSQGSLALSVADRRGSGGHIFRKHPQTSSSGDPCQDGIFISGQQNYSSATLSHKDVPPDSLMKMPLSNGQMGQPLRPQANYSQIHHPPQASVARHPSREQLIDYLMLKVAHQPPYTQPHCSPRQGHELAKQE

SEQ ID NO: 27994 - protein, 197 aa, Homo sapiens
  Payload ID: 5519
  Gene Symbol: ERBB2IP
  Gene Name: erbb2 interacting protein
  ENSP ID: ENSP00000425728
  MOD_RES (1)..(1): Any amino acid
XSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKSMLSRSFNSNFTTVSSFHCGSSRDLHGSQGSLALSVADRRGSGGHIFRKHPQTSSSGDPCQDGIFISGQQNYSSATLSHKDVPPDSLMKV

SEQ ID NO: 27995 - protein, 1419 aa, Homo sapiens
  Payload ID: 5519
  Gene Symbol: ERBB2IP
  Gene Name: erbb2 interacting protein
  Uniprot ID: Q96RT1
  ENSP ID: ENSP00000426632
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKSMLSRSFNSNFTTVSSFHCGSSRDLHGSQGSLALSVADRRGSGGHIFRMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27996 - protein, 1255 aa, Homo sapiens [sequence omitted]

SEQ ID NO: 27997 - protein, 1225 aa, Homo sapiens
  Payload ID: 5520
  Gene Symbol: ERBB2
  Gene Name: erb-b2 receptor tyrosine kinase 2
  Uniprot ID: P04626
  ENSP ID: ENSP00000385185
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 27998 - protein, 979 aa, Homo sapiens
  Payload ID: 5520
  Gene Symbol: ERBB2
  Gene Name: erb-b2 receptor tyrosine kinase 2
  ENSP ID: ENSP00000404047
MELAALCRWGLLLALLPPGAASTQDNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 27999 - protein, 1240 aa, Homo sapiens
  Payload ID: 5520
  Gene Symbol: ERBB2
  Gene Name: erb-b2 receptor tyrosine kinase 2
  Uniprot ID: P04626
  ENSP ID: ENSP00000446466
MPRGSWKPQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 28000 - protein, 96 aa, Homo sapiens
  Payload ID: 5520
  Gene Symbol: ERBB2
  Gene Name: erb-b2 receptor tyrosine kinase 2
  ENSP ID: ENSP00000462024
MELAALCRWGLLLALLPPGAASTQVCTGTDMKLRLPASPETHLDMLRHLYQGCQVVQGNLELTYLPTNASLSFLQTTTFLRTWDPAPSSAPCTTKR

SEQ ID NO: 28001 - protein, 139 aa, Homo sapiens
  Payload ID: 5520
  Gene Symbol: ERBB2
  Gene Name: erb-b2 receptor tyrosine kinase 2
  ENSP ID: ENSP00000462270
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILW

SEQ ID NO: 28002 - protein, 1225 aa, Homo sapiens; identical to SEQ ID NO: 27997
  Payload ID: 5520
  Gene Symbol: ERBB2
  Gene Name: erb-b2 receptor tyrosine kinase 2
  Uniprot ID: P04626
  ENSP ID: ENSP00000462438

SEQ ID NO: 28003 - protein, 603 aa, Homo sapiens
  Payload ID: 5520
  Gene Symbol: ERBB2
  Gene Name: erb-b2 receptor tyrosine kinase 2
  ENSP ID: ENSP00000462808
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHS

SEQ ID NO: 28004 - protein, 251 aa, Homo sapiens
  Payload ID: 5520
  Gene Symbol: ERBB2
  Gene Name: erb-b2 receptor tyrosine kinase 2
  ENSP ID: ENSP00000463002
  MOD_RES (1)..(1): Any amino acid
XPDEEGACQPCPINCTHSPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGG

SEQ ID NO: 28005 - protein, 90 aa, Homo sapiens
  Payload ID: 5520
  Gene Symbol: ERBB2
  Gene Name: erb-b2 receptor tyrosine kinase 2
  ENSP ID: ENSP00000463427
MELAALCRWGLLLALLPPGAASTQVCTGTDMKLRLPASPETHLDMLRHLYQGCQVVQGNLELTYLPTNASLSFLQVRPVGNPARPCLQLG

SEQ ID NO: 28006 - protein, 1055 aa, Homo sapiens
  Payload ID: 5520
  Gene Symbol: ERBB2
  Gene Name: erb-b2 receptor tyrosine kinase 2
  ENSP ID: ENSP00000463714
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRNM

SEQ ID NO: 28007 - protein, 102 aa, Homo sapiens
  Payload ID: 5520
  Gene Symbol: ERBB2
  Gene Name: erb-b2 receptor tyrosine kinase 2
  ENSP ID: ENSP00000463719
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGA

SEQ ID NO: 28008 - protein, 177 aa, Homo sapiens
  Payload ID: 5520
  Gene Symbol: ERBB2
  Gene Name: erb-b2 receptor tyrosine kinase 2
  ENSP ID: ENSP00000464252
  MOD_RES (1)..(1): Any amino acid
XPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKGIWIPDGENVKIP

SEQ ID NO: 28009 - protein, 166 aa, Homo sapiens
  Payload ID: 5520
  Gene Symbol: ERBB2
  Gene Name: erb-b2 receptor tyrosine kinase 2
  ENSP ID: ENSP00000464420
  MOD_RES (1)..(1): Any amino acid
XHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGVSLCQQAGVQWYDLGSLQPLPPGFKQFSCLSLLSSWDYRDP

SEQ ID NO: 28010 - protein, 1342 aa, Homo sapiens
  Payload ID: 5521
  Gene Symbol: ERBB3
  Gene Name: erb-b2 receptor tyrosine kinase 3
  Uniprot ID: P21860
  ENSP ID: ENSP00000267101
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 28011 - protein, 1283 aa, Homo sapiens
  Payload ID: 5521
  Gene Symbol: ERBB3
  Gene Name: erb-b2 receptor tyrosine kinase 3
  Uniprot ID: P21860
  ENSP ID: ENSP00000408340
MGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 28012 - protein, 183 aa, Homo sapiens
  Payload ID: 5521
  Gene Symbol: ERBB3
  Gene Name: erb-b2 receptor tyrosine kinase 3
  Uniprot ID: P21860
  ENSP ID: ENSP00000415753
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTGQFPMVPSGLTPQPAQDWYLLDDDPRLLTLSASSKVPVTLAAV

SEQ ID NO: 28013 - protein, 331 aa, Homo sapiens
  Payload ID: 5521
  Gene Symbol: ERBB3
  Gene Name: erb-b2 receptor tyrosine kinase 3
  Uniprot ID: P21860
  ENSP ID: ENSP00000447510
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKAF

SEQ ID NO: 28014 - protein, 921 aa, Homo sapiens
  Payload ID: 5521
  Gene Symbol: ERBB3
  Gene Name: erb-b2 receptor tyrosine kinase 3
  ENSP ID: ENSP00000448483
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGQCIWMPSLPSLAPVSNLPFETPS

SEQ ID NO: 28015 - protein, 126 aa, Homo sapiens
  Payload ID: 5521
  Gene Symbol: ERBB3
  Gene Name: erb-b2 receptor tyrosine kinase 3
  ENSP ID: ENSP00000448636
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTN

SEQ ID NO: 28016 - protein, 43 aa, Homo sapiens
  Payload ID: 5521
  Gene Symbol: ERBB3
  Gene Name: erb-b2 receptor tyrosine kinase 3
  ENSP ID: ENSP00000448671
MRANDALQVPRAQSTSTQMFRMNVGPAMRTAPRGVKDQSFKTV

SEQ ID NO: 28017 - protein, 462 aa, Homo sapiens
  Payload ID: 5521
  Gene Symbol: ERBB3
  Gene Name: erb-b2 receptor tyrosine kinase 3
  ENSP ID: ENSP00000448729
MPMSTILPVTSPCLPATGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 28018 - protein, 649 aa, Homo sapiens
  Payload ID: 5521
  Gene Symbol: ERBB3
  Gene Name: erb-b2 receptor tyrosine kinase 3
  ENSP ID: ENSP00000448946
CLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 28019 - protein, 583 aa, Homo sapiens
  Payload ID: 5521
  Gene Symbol: ERBB3
  Gene Name: erb-b2 receptor tyrosine kinase 3
  ENSP ID: ENSP00000449129
MLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 28020 - protein, 116 aa, Homo sapiens
  Payload ID: 5521
  Gene Symbol: ERBB3
  Gene Name: erb-b2 receptor tyrosine kinase 3
  ENSP ID: ENSP00000449138
MGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIV

SEQ ID NO: 28021 - protein, 115 aa, Homo sapiens
  Payload ID: 5521
  Gene Symbol: ERBB3
  Gene Name: erb-b2 receptor tyrosine kinase 3
  ENSP ID: ENSP00000449713
MGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEI

SEQ ID NO: 28022 - protein, 81 aa, Homo sapiens
  Payload ID: 5521
  Gene Symbol: ERBB3
  Gene Name: erb-b2 receptor tyrosine kinase 3
  ENSP ID: ENSP00000482073
LDIKHNRPRRDCVAEGKVCDPLCSSGGCWGPGPGQCLSCRNYSRGGVCVTHCNFLNGYSKGSQSRMGGGGALQWNCSGGIQ

SEQ ID NO: 28023 - protein, 731 aa, Homo sapiens
  Payload ID: 5522
  Gene Symbol: ERBB4
  Gene Name: erb-b2 receptor tyrosine kinase 4
  ENSP ID: ENSP00000260943
  MOD_RES (1)..(1): Any amino acid
XKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCIGSSIEDCIGLMDRTPLIAAGVIGGLFILVIVGLTFAVYVRRKSIKKKRALRRFLETELVEPLTPSGTAPNQAQLRILKETELKRVKVLGSGAFGTVYKGIWVPEG

SEQ ID NO: 28024 - protein, 1308 aa, Homo sapiens
  Payload ID: 5522
  Gene Symbol: ERBB4
  Gene Name: erb-b2 receptor tyrosine kinase 4
  Uniprot ID: Q15303
  ENSP ID: ENSP00000342235
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 28025 - protein, 1249 aa, Homo sapiens
  Payload ID: 5522
  Gene Symbol: ERBB4
  Gene Name: erb-b2 receptor tyrosine kinase 4
  ENSP ID: ENSP00000385565
MGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 28026 - protein, 1292 aa, Homo sapiens
  Payload ID: 5522
  Gene Symbol: ERBB4
  Gene Name: erb-b2 receptor tyrosine kinase 4
  Uniprot ID: Q15303
  ENSP ID: ENSP00000403204
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 28027 - protein, 128 aa, Homo sapiens
  Payload ID: 5522
  Gene Symbol: ERBB4
  Gene Name: erb-b2 receptor tyrosine kinase 4
  ENSP ID: ENSP00000405564
MGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCG

SEQ ID NO: 28028 - protein, 145 aa, Homo sapiens; identical to SEQ ID NO: 26995
  Payload ID: 5523
  Gene Symbol:
  Gene Name: ERC1
  ENSP ID: ENSP00000488936

SEQ ID NO: 28029 - protein, 948 aa, Homo sapiens; identical to SEQ ID NO: 26986
  Payload ID: 5523
  Gene Symbol:
  Gene Name: ERC1
  ENSP ID: ENSP00000489059

SEQ ID NO: 28030 - protein, 720 aa, Homo sapiens; identical to SEQ ID NO: 26993
  Payload ID: 5523
  Gene Symbol:
  Gene Name: ERC1
  ENSP ID: ENSP00000489064

SEQ ID NO: 28031 - protein, 344 aa, Homo sapiens; identical to SEQ ID NO: 26999
  Payload ID: 5523
  Gene Symbol:
  Gene Name: ERC1
  ENSP ID: ENSP00000489077

SEQ ID NO: 28032 - protein, 285 aa, Homo sapiens; identical to SEQ ID NO: 26998
  Payload ID: 5523
  Gene Symbol:
  Gene Name: ERC1
  ENSP ID: ENSP00000489084
  MOD_RES (1)..(1): Any amino acid

SEQ ID NO: 28033 - protein, 1116 aa, Homo sapiens; identical to SEQ ID NO: 26988
  Payload ID: 5523
  Gene Symbol:
  Gene Name: ERC1
  ENSP ID: ENSP00000489120

SEQ ID NO: 28034 - protein, 1088 aa, Homo sapiens; identical to SEQ ID NO: 26989
  Payload ID: 5523
  Gene Symbol:
  Gene Name: ERC1
  ENSP ID: ENSP00000489206

SEQ ID NO: 28035 - protein, 992 aa, Homo sapiens; identical to SEQ ID NO: 26990
  Payload ID: 5523
  Gene Symbol:
  Gene Name: ERC1
  ENSP ID: ENSP00000489265

SEQ ID NO: 28036 - protein, 1120 aa, Homo sapiens; identical to SEQ ID NO: 26992
  Payload ID: 5523
  Gene Symbol:
  Gene Name: ERC1
  ENSP ID: ENSP00000489348

SEQ ID NO: 28037 - protein, 1116 aa, Homo sapiens; identical to SEQ ID NO: 26988
  Payload ID: 5523
  Gene Symbol:
  Gene Name: ERC1
  ENSP ID: ENSP00000489361

SEQ ID NO: 28038 - protein, 89 aa, Homo sapiens; identical to SEQ ID NO: 26997
  Payload ID: 5523
  Gene Symbol:
  Gene Name: ERC1
  ENSP ID: ENSP00000489387
  MOD_RES (1)..(1): Any amino acid

SEQ ID NO: 28039 - protein, 976 aa, Homo sapiens; identical to SEQ ID NO: 26994
  Payload ID: 5523
  Gene Symbol:
  Gene Name: ERC1
  ENSP ID: ENSP00000489414

SEQ ID NO: 28040 - protein, 1088 aa, Homo sapiens; identical to SEQ ID NO: 26989
  Payload ID: 5523
  Gene Symbol:
  Gene Name: ERC1
  ENSP ID: ENSP00000489460

SEQ ID NO: 28041 - protein, 1086 aa, Homo sapiens; identical to SEQ ID NO: 26987
  Payload ID: 5523
  Gene Symbol:
  Gene Name: ERC1
  ENSP ID: ENSP00000489593

SEQ ID NO: 28042 - protein, 89 aa, Homo sapiens; identical to SEQ ID NO: 26996
  Payload ID: 5523
  Gene Symbol:
  Gene Name: ERC1
  ENSP ID: ENSP00000489594

SEQ ID NO: 28043 - protein, 720 aa, Homo sapiens; identical to SEQ ID NO: 26993
  Payload ID: 5523
  Gene Symbol:
  Gene Name: ERC1
  ENSP ID: ENSP00000489601

SEQ ID NO: 28044 - protein, 1061 aa, Homo sapiens
  Payload ID: 5524
  Gene Symbol: ERCC6-PGBD3
  Gene Name: ERCC6-PGBD3 readthrough
  ENSP ID: ENSP00000387966
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLSPKMPRTLSLHEITDLLETDDSIEASAIVIQPPENATAPVSDEESGDEEGGTINNLPGSLLHTAAYLIQDGSDAESDSDDPSYAPKDDSPDEVPSTFTVQQPPPSRRRKMTKILCKWKKADLTVQPVAGRVTAPPNDFFTVMRTPTEILELFLDDEVIELIVKYSNLYACSKGVHLGLTSSEFKCFLGIIFLSGYVSVPRRRMFWEQRTDVHNVLVSAAMRRDRFETIFSNLHVADNANLDPVDKFSKLRPLISKLNERCMKFVPNETYFSFDEFMVPYFGRHGCKQFIRGKPIRFGYKFWCGATCLGYICWFQPYQGKNPNTKHEEYGVGASLVLQFSEALTEAHPGQYHFVFNNFFTSIALLDKLSSMGHQATGTVRKDHIDRVPLESDVALKKKERGTFDYRIDGKGNIVCRWNDNSVVTVASSGAGIHPLCLVSRYSQKLKKKIQVQQPNMIKVYNQFMGGVDRADENIDKYRASIRGKKWYSSPLLFCFELVLQNAWQLHKTYDEKPVDFLEFRRRVVCHYLETHGHPPEPGQKGRPQKRNIDSRYDGINHVIVKQGKQTRCAECHKNTTFRCEKCDVALHVKCSVEYHTE

SEQ ID NO: 28045 - protein, 1061 aa, Homo sapiens; identical to SEQ ID NO: 28044
  Payload ID: 5524
  Gene Symbol: ERCC6-PGBD3
  Gene Name: ERCC6-PGBD3 readthrough
  ENSP ID: ENSP00000423550

SEQ ID NO: 28046 - protein, 377 aa, Homo sapiens
  Payload ID: 5525
  Gene Symbol: ERGIC2
  Gene Name: ERGIC and golgi 2
  Uniprot ID: Q96RQ1
  ENSP ID: ENSP00000353270
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVGKAIPHPRGHAHLAALVNHESYNFSHRIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTGMLHGIGKFIVEIICCRFRLGSYKPVNSVPFEDGHTDNHLPLLENNTH

SEQ ID NO: 28047 - protein, 172 aa, Homo sapiens
  Payload ID: 5525
  Gene Symbol: ERGIC2
  Gene Name: ERGIC and golgi 2
  ENSP ID: ENSP00000447165
MRRLNRKKTLSLVKELDAFPKVPESYVETSASGGTVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVG

SEQ ID NO: 28048 - protein, 57 aa, Homo sapiens
  Payload ID: 5525
  Gene Symbol: ERGIC2
  Gene Name: ERGIC and golgi 2
  ENSP ID: ENSP00000447212
  MOD_RES (1)..(1): Any amino acid
XAIPHPRGHAHLAALVNHESYNFSHRIDHLSFGELVPAIINPLDGTEKIAIDLFFVF

SEQ ID NO: 28049 - protein, 49 aa, Homo sapiens
  Payload ID: 5525
  Gene Symbol: ERGIC2
  Gene Name: ERGIC and golgi 2
  ENSP ID: ENSP00000447678
ERIINHAAGSHGVSGIFMKYDLSSLMVTVTEEHMPFWQFFACYMELENL

SEQ ID NO: 28050 - protein, 175 aa, Homo sapiens
  Payload ID: 5525
  Gene Symbol: ERGIC2
  Gene Name: ERGIC and golgi 2
  ENSP ID: ENSP00000448426
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGH

SEQ ID NO: 28051 - protein, 71 aa, Homo sapiens
  Payload ID: 5525
  Gene Symbol: ERGIC2
  Gene Name: ERGIC and golgi 2
  ENSP ID: ENSP00000448482
MRRLNRKKTLSLVKELDAFPKVPESYVETSASGGTVSLIAFTTMALLTIMEFSVYQDTWMKYEYEVDKDFS

SEQ ID NO: 28052 - protein, 209 aa, Homo sapiens
  Payload ID: 5525
  Gene Symbol: ERGIC2
  Gene Name: ERGIC and golgi 2
  ENSP ID: ENSP00000448535
  MOD_RES (1)..(1): Any amino acid
XFKSAFKSTSTALPPREDDSSQSPNACRIHGHLYVNKVAGNFHITVGKIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTGMLHGIGKFIVEIICCRFRLGSYKPVNSVPFEDGHTDNHLPLLENNTH

SEQ ID NO: 28053 - protein, 163 aa, Homo sapiens
  Payload ID: 5525
  Gene Symbol: ERGIC2
  Gene Name: ERGIC and golgi 2
  ENSP ID: ENSP00000448585
  MOD_RES (1)..(1): Any amino acid
XAIPHPRGHAHLAALVNHESYNFSHRIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTDLDPINLSILFLLRMATQTTTYLF

SEQ ID NO: 28054 - protein, 203 aa, Homo sapiens
  Payload ID: 5525
  Gene Symbol: ERGIC2
  Gene Name: ERGIC and golgi 2
  ENSP ID: ENSP00000449691
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPRAIPHPRGHAHLAALVNHESYNFSHRIDHLSFGELVPAIINPLDG

SEQ ID NO: 28055 - protein, 220 aa, Homo sapiens
  Payload ID: 5525
  Gene Symbol: ERGIC2
  Gene Name: ERGIC and golgi 2
  ENSP ID: ENSP00000450042
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVGKAIPHPRGHAHLAALVNHESYNFSHRIDHL

SEQ ID NO: 28056 - protein, 386 aa, Homo sapiens
  Payload ID: 5525
  Gene Symbol: ERGIC2
  Gene Name: ERGIC and golgi 2
  ENSP ID: ENSP00000478266
MKEEEGFPEDEATESEKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVGKAIPHPRGHAHLAALVNHESYNFSHRIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTGMLHGIGKFIVEIICCRFRLGSYKPVNSVPFEDGHTDNHLPLLENNTH

SEQ ID NO: 28057 - protein, 383 aa, Homo sapiens
  Payload ID: 5526
  Gene Symbol: ERGIC3
  Gene Name: ERGIC and golgi 3
  Uniprot ID: Q9Y282
  ENSP ID: ENSP00000341358
MEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 28058 - protein, 388 aa, Homo sapiens
  Payload ID: 5526
  Gene Symbol: ERGIC3
  Gene Name: ERGIC and golgi 3
  Uniprot ID: Q9Y282
  ENSP ID: ENSP00000349970
MEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHAVEIHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 28059 - protein, 123 aa, Homo sapiens
  Payload ID: 5526
  Gene Symbol: ERGIC3
  Gene Name: ERGIC and golgi 3
  ENSP ID: ENSP00000389398
MEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHD

SEQ ID NO: 28060 - protein, 397 aa, Homo sapiens
  Payload ID: 5526
  Gene Symbol: ERGIC3
  Gene Name: ERGIC and golgi 3
  ENSP ID: ENSP00000399124
  MOD_RES (1)..(1): Any amino acid
XALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHGCVCRLKMIARSLACVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 28061 - protein, 326 aa, Homo sapiens
  Payload ID: 5526
  Gene Symbol: ERGIC3
  Gene Name: ERGIC and golgi 3
  ENSP ID: ENSP00000402480
  MOD_RES (1)..(1): Any amino acid
XAYPKTLEDFRVKTCGGATVTIVSGLLMLLLFLSELQYYLTTEVHPELYVDKSRGDKLKINIDVLFPHMPCAWSQYLSLIFLLPDLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVL

SEQ ID NO: 28062 - protein, 157 aa, Homo sapiens
  Payload ID: 5526
  Gene Symbol: ERGIC3
  Gene Name: ERGIC and golgi 3
  ENSP ID: ENSP00000408840
  MOD_RES (1)..(1): Any amino acid
XHYIQHLSFGEDYPGIVNPLDHTNVTAPQASMMFQYFVKVVPTVYMKVDGEAQQERGRSRGGADGGWSQVLALALAQAPLPPQVLRTNQFSVTRHEKVANGLLGDQGLPGVFVLYELSPMMVKLTEKHRSFTHFLTGVCAIIGGMFTVAGLIDSLIY

SEQ ID NO: 28063 - protein, 118 aa, Homo sapiens
  Payload ID: 5526
  Gene Symbol: ERGIC3
  Gene Name: ERGIC and golgi 3
  ENSP ID: ENSP00000414490
LKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHAD

SEQ ID NO: 28064 - protein, 130 aa, Homo sapiens
  Payload ID: 5526
  Gene Symbol: ERGIC3
  Gene Name: ERGIC and golgi 3
  ENSP ID: ENSP00000416402
  MOD_RES (1)..(1): Any amino acid
XPLDHTNVTAPQASMMFQYFVKVVPTVYMKVDGEAPLPPQVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 28065 - protein, 328 aa, Homo sapiens
  Payload ID: 5527
  Gene Symbol: ERI2
  Gene Name: ERI1 exoribonuclease family member 2
  Uniprot ID: A8K979
  ENSP ID: ENSP00000300005
MATKRLARQLGLIRRKSIAPANGNLGRSKSKQLFDYLIVIDFESTCWNDGKHHHSQEIIEFPAVLLNTSTGQIDSEFQAYVQPQEHPILSEFCMELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMKITRSLNKGPFLLPSWTWNSDLASGDQHAFLQQEFGCGTYRTLLQKPNMSKQEKGNILWLTMVWLSLACLQRKNYNDCMLNTASQTVTTEKF

SEQ ID NO: 28066 - protein, 691 aa, Homo sapiens
  Payload ID: 5527
  Gene Symbol: ERI2
  Gene Name: ERI1 exoribonuclease family member 2
  Uniprot ID: A8K979
  ENSP ID: ENSP00000350651
MATKRLARQLGLIRRKSIAPANGNLGRSKSKQLFDYLIVIDFESTCWNDGKHHHSQEIIEFPAVLLNTSTGQIDSEFQAYVQPQEHPILSEFCMELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMKITRSLNKVPTKKNFSILARNLNTIQVEEMSACNISIQGPSIYNKEPKNIINPHEKVQMKSICANSPIKAQQDQLQVKNNIKASLHNVKSSLPLFNTKSSTSVGQLQSPTLNSPIYMQKQGKNEHLAFNTKSKASTVGSELVLVSTTVPTVHHVSDLEMSSTLDCLPVLADWEDVVLLPASQPEENVDCTVPISDSDLEISFNSGERLMVLKELEMSSHENFGDIEETPQKSETSKSIVYKSPHTTIYNVKEAKDPGSDISAFKLPEHKSSTFNRVNANMSHPLVLGKHPLLSGGTKRNPCSPQAFPPAKKQPFTIHEEKPTSSDCSPVRSSSWRRLPSILTSTVNLQEPWKSGKMTPPLCKCGRRSKRLVVSNNGPNHGKVFYCCPIGKYQENRKCCGYFKWEQTLQKERANSMVPSHSTGGLTFSSPETSHICDRNLSISTKNSLRLRPSMRN

SEQ ID NO: 28067 - protein, 598 aa, Homo sapiens
  Payload ID: 5527
  Gene Symbol: ERI2
  Gene Name: ERI1 exoribonuclease family member 2
  Uniprot ID: A8K979
  ENSP ID: ENSP00000454661
MELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMKITRSLNKVPTKKNFSILARNLNTIQVEEMSACNISIQGPSIYNKEPKNIINPHEKVQMKSICANSPIKAQQDQLQVKNNIKASLHNVKSSLPLFNTKSSTSVGQLQSPTLNSPIYMQKQGKNEHLAFNTKSKASTVGSELVLVSTTVPTVHHVSDLEMSSTLDCLPVLADWEDVVLLPASQPEENVDCTVPISDSDLEISFNSGERLMVLKELEMSSHENFGDIEETPQKSETSKSIVYKSPHTTIYNVKEAKDPGSDISAFKLPEHKSSTFNRVNANMSHPLVLGKHPLLSGGTKRNPCSPQAFPPAKKQPFTIHEEKPTSSDCSPVRSSSWRRLPSILTSTVNLQEPWKSGKMTPPLCKCGRRSKRLVVSNNGPNHGKVFYCCPIGKYQENRKCCGYFKWEQTLQKERANSMVPSHSTGGLTFSSPETSHICDRNLSISTKNSLRLRPSMRN

SEQ ID NO: 28068 - protein, 156 aa, Homo sapiens
  Payload ID: 5527
  Gene Symbol: ERI2
  Gene Name: ERI1 exoribonuclease family member 2
  ENSP ID: ENSP00000454720
MATKRLARQLGLIRRKSIAPANGNLGRSKSKQLFDYLIVIDFESTCWNDGKHHHSQEIIEFPAVLLNTSTGQIDSEFQAYVQPQEHPILSEFCMELTGIKQAQVDEGVPLKICLSQFCKWIHKIQQQKNIIFATGISEPSASEVKLCAFVTWSAFL

SEQ ID NO: 28069 - protein, 598 aa, Homo sapiens; identical to SEQ ID NO: 28067
  Payload ID: 5527
  Gene Symbol: ERI2
  Gene Name: ERI1 exoribonuclease family member 2
  Uniprot ID: A8K979
  ENSP ID: ENSP00000455982

SEQ ID NO: 28070 - protein, 279 aa, Homo sapiens
  Payload ID: 5527
  Gene Symbol: ERI2
  Gene Name: ERI1 exoribonuclease family member 2
  Uniprot ID: A8K979
  ENSP ID: ENSP00000457488
MATKRLARQLGLIRRKSIAPANGNLGRSKSKQLFDYLIVIDFESTCWNDGKHHHSQEIIEFPAVLLNTSTGQIDSEFQAYVQPQEHPILSEFCMELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMKITRSLNKVVPKGIHAVPKLSHQQKNNPSLFMKKSLHHLIAPQ

SEQ ID NO: 28071 - protein, 337 aa, Homo sapiens
  Payload ID: 5528
  Gene Symbol: ERI3
  Gene Name: ERI1 exoribonuclease family member 3
  Uniprot ID: O43414
  ENSP ID: ENSP00000361331
MATASPAADGGRGRPWEGGLVSWPPAPPLTLPWTWMGPSWGQHPGHWGFPALTEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 28072 - protein, 222 aa, Homo sapiens
  Payload ID: 5528
  Gene Symbol: ERI3
  Gene Name: ERI1 exoribonuclease family member 3
  Uniprot ID: O43414
  ENSP ID: ENSP00000361333
MFVMLQVPWLQSCANLVQIGAPLPLLGCLGQYFEVLGSMEVLAGQYGMEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 28073 - protein, 204 aa, Homo sapiens
  Payload ID: 5528
  Gene Symbol: ERI3
  Gene Name: ERI1 exoribonuclease family member 3
  ENSP ID: ENSP00000390710
LQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKGSSPGTASGTSCYQSEEAQRKENTPGVKAYSFAMGCWPKNGLLDMNKGLSLQHIGRPHSGIDDCKNIANIMKTLAYRGFIFKQTSKPF

SEQ ID NO: 28074 - protein, 176 aa, Homo sapiens
  Payload ID: 5528
  Gene Symbol: ERI3
  Gene Name: ERI1 exoribonuclease family member 3
  ENSP ID: ENSP00000396764
MATASPAADGGRGRPWEGGLVSWPPAPPLTLPWTWMGPSWGQHPGEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDM

SEQ ID NO: 28075 - protein, 250 aa, Homo sapiens
  Payload ID: 5528
  Gene Symbol: ERI3
  Gene Name: ERI1 exoribonuclease family member 3
  ENSP ID: ENSP00000412291
MATASPAADGGRGRPWEGGLVSWPPAPPLTLPWTWMGPSWGQHPGHWGFPALTEPSASPAAGLGIFEVRRDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKV

SEQ ID NO: 28076 - protein, 297 aa, Homo sapiens
  Payload ID: 5529
  Gene Symbol: ERMN
  Gene Name: ermin, ERM-like protein
  Uniprot ID: Q8TAM6
  ENSP ID: ENSP00000380453
MKTLSPDRIQPHIMTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 28077 - protein, 284 aa, Homo sapiens
  Payload ID: 5529
  Gene Symbol: ERMN
  Gene Name: ermin, ERM-like protein
  Uniprot ID: Q8TAM6
  ENSP ID: ENSP00000387047
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 28078 - protein, 146 aa, Homo sapiens
  Payload ID: 5529
  Gene Symbol: ERMN
  Gene Name: ermin, ERM-like protein
  ENSP ID: ENSP00000387049
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREDGVSLLLPRLECNGAISADCNLCLQGSSDSPASAS

SEQ ID NO: 28079 - protein, 146 aa, Homo sapiens; identical to SEQ ID NO: 28078
  Payload ID: 5529
  Gene Symbol: ERMN
  Gene Name: ermin, ERM-like protein
  ENSP ID: ENSP00000387325

SEQ ID NO: 28080 - protein, 84 aa, Homo sapiens
  Payload ID: 5529
  Gene Symbol: ERMN
  Gene Name: ermin, ERM-like protein
  ENSP ID: ENSP00000387339
MTDVPATFTQAECNGDKPPENGQQTITKISEELTDVDSPLPHYRVEPSLEGALTKGSQEERRKLQGNMLLNSSMEDKMLKGWSI

SEQ ID NO: 28081 - protein, 152 aa, Homo sapiens
  Payload ID: 5529
  Gene Symbol: ERMN
  Gene Name: ermin, ERM-like protein
  ENSP ID: ENSP00000389595
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGH

SEQ ID NO: 28082 - protein, 160 aa, Homo sapiens
  Payload ID: 5529
  Gene Symbol: ERMN
  Gene Name: ermin, ERM-like protein
  ENSP ID: ENSP00000398149
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWL

SEQ ID NO: 28083 - protein, 264 aa, Homo sapiens
  Payload ID: 5529
  Gene Symbol: ERMN
  Gene Name: ermin, ERM-like protein
  ENSP ID: ENSP00000410646
MTDVPATFTQAECNGDKPPENGQQTITKISEELTDVDSPLPHYRVEPSLEGALTKGSQEERRKLQGNMLLNSSMEDKMLKETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 28084 - protein, 111 aa, Homo sapiens
  Payload ID: 5529
  Gene Symbol: ERMN
  Gene Name: ermin, ERM-like protein
  ENSP ID: ENSP00000410934
MTDVPATFTQAECNGDKPPENGQQTITKISEELTDVDSPLPHYRVEPSLEGALTKGSQEERRKLQGNMLLNSSMEDKMLKEEKLFIVHKAITDLSLQETSADEMTFREGHQ

SEQ ID NO: 28085 - protein, 385 aa, Homo sapiens
  Payload ID: 5530
  Gene Symbol: ERMAP
  Gene Name: erythroblast membrane-associated protein (Scianna blood group)
  ENSP ID: ENSP00000332439
MPEYKGRTVLVRDAQEGSVTLQILDVRLEDQGSYRCLIQVGNLSKEDTVILQVAAPSVGSLSPSAVALAVILPVLVLLIMVCLCLIWKQRRAKEKLLYEHVTEVDNLLSDHAKEKGKLHKAVKKLRSELKLKRAAANSGWRRARLHFVAVTLDPDTAHPKLILSEDQRCVRLGDRRQPVPDNPQRFDFVVSILGSEYFTTGCHYWEVYVGDKTKWILGVCSESVSRKGKVTASPANGHWLLRQSRGNEYEALTSPQTSFRLKEPPRCVGIFLDYEAGVISFYNVTNKSHIFTFTHNFSGPLRPFFEPCLHDGGKNTAPLVICSELHKSEESIVPRPEGKGHANGDVSLKVNSSLLPPKAPELKDIILSLPPDLGPALQELKAPSF

SEQ ID NO: 28086 - protein, 475 aa, Homo sapiens
  Payload ID: 5530
  Gene Symbol: ERMAP
  Gene Name: erythroblast membrane-associated protein (Scianna blood group)
  Uniprot ID: Q96PL5
  ENSP ID: ENSP00000361592
MEMASSAGSWLSGCLIPLVFLRLSVHVSGHAGDAGKFHVALLGGTAELLCPLSLWPGTVPKEVRWLRSPFPQRSQAVHIFRDGKDQDEDLMPEYKGRTVLVRDAQEGSVTLQILDVRLEDQGSYRCLIQVGNLSKEDTVILQVAAPSVGSLSPSAVALAVILPVLVLLIMVCLCLIWKQRRAKEKLLYEHVTEVDNLLSDHAKEKGKLHKAVKKLRSELKLKRAAANSGWRRARLHFVAVTLDPDTAHPKLILSEDQRCVRLGDRRQPVPDNPQRFDFVVSILGSEYFTTGCHYWEVYVGDKTKWILGVCSESVSRKGKVTASPANGHWLLRQSRGNEYEALTSPQTSFRLKEPPRCVGIFLDYEAGVISFYNVTNKSHIFTFTHNFSGPLRPFFEPCLHDGGKNTAPLVICSELHKSEESIVPRPEGKGHANGDVSLKVNSSLLPPKAPELKDIILSLPPDLGPALQELKAPSF

SEQ ID NO: 28087 - protein, 475 aa, Homo sapiens; identical to SEQ ID NO: 28086
  Payload ID: 5530
  Gene Symbol: ERMAP
  Gene Name: erythroblast membrane-associated protein (Scianna blood group)
  Uniprot ID: Q96PL5
  ENSP ID: ENSP00000361595

SEQ ID NO: 28088 - protein, 775 aa, Homo sapiens
  Payload ID: 5531
  Gene Symbol: EPB41
  Gene Name: erythrocyte membrane protein band 4.1
  Uniprot ID: P11171
  ENSP ID: ENSP00000290100
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVETWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 28089 - protein, 641 aa, Homo sapiens
  Payload ID: 5531
  Gene Symbol: EPB41
  Gene Name: erythrocyte membrane protein band 4.1
  Uniprot ID: P11171
  ENSP ID: ENSP00000317597
MHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKVEKTHIEVTVPTSNGDQTQKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 28090 - protein, 864 aa, Homo sapiens
  Payload ID: 5531
  Gene Symbol: EPB41
  Gene Name: erythrocyte membrane protein band 4.1
  Uniprot ID: P11171
  ENSP ID: ENSP00000345259
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKVEKTHIEVTVPTSNGDQTQKLAEKTEDLIRMRKKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 28091 - protein, 622 aa, Homo sapiens
  Payload ID: 5531
  Gene Symbol: EPB41
  Gene Name: erythrocyte membrane protein band 4.1
  ENSP ID: ENSP00000348397
MHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 28092 - protein, 720 aa, Homo sapiens
  Payload ID: 5531
  Gene Symbol: EPB41
  Gene Name: erythrocyte membrane protein band 4.1
  Uniprot ID: P11171
  ENSP ID: ENSP00000362903
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKVEKTHIEVTVPTSNGDQTQKKRERLDGENIYIRHSNLMLEDLDKSQEEIKKHHASISELKKNFMESVPEPRPSEWDKRLSTHSPFRTLNINGQIPTGEGVSTLST

SEQ ID NO: 28093 - protein, 864 aa, Homo sapiens; identical to SEQ ID NO: 28090
  Payload ID: 5531
  Gene Symbol: EPB41
  Gene Name: erythrocyte membrane protein band 4.1
  Uniprot ID: P11171
  ENSP ID: ENSP00000362904

SEQ ID NO: 28094 - protein, 588 aa, Homo sapiens
  Payload ID: 5531
  Gene Symbol: EPB41
  Gene Name: erythrocyte membrane protein band 4.1
  Uniprot ID: P11171
  ENSP ID: ENSP00000362906
MHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTVKGGISETRIEKRIVITGDADIDHDQVLVQAIKEAKEQHPDMSVTKVVVHQETEIADE

SEQ ID NO: 28095 - protein, 686 aa, Homo sapiens
  Payload ID: 5532
  Gene Symbol: EPB41L4A
  Gene Name: erythrocyte membrane protein band 4.1 like 4A
  Uniprot ID: Q9HCS5
  ENSP ID: ENSP00000261486
MGCFCAVPEEFYCEVLLLDESKLTLTTQQQGIKKSTKGSVVLDHVFHHVNLVEIDYFGLRYCDRSHQTYWLDPAKTLAEHKELINTGPPYTLYFGIKFYAEDPCKLKEEITRYQFFLQVKQDVLQGRLPCPVNTAAQLGAYAIQSELGDYDPYKHTAGYVSEYRFVPDQKEELEEAIERIHKTLMGQIPSEAELNYLRTAKSLEMYGVDLHPVYGENKSEYFLGLTPVGVVVYKNKKQVGKYFWPRITKVHFKETQFELRVLGKDCNETSFFFEARSKTACKHLWKCSVEHHTFFRMPENESNSLSRKLSKFGSIRYKHRYSGRTALQMSRDLSIQLPRPDQNVTRSRSKTYPKRIAQTQPAESNSISRITANMENGENEGTIKIIAPSPVKSFKKAKNENSPDTQRSKSHAPWEENGPQSGLYNSPSDRTKSPKFPYTRRRNPSCGSDNDSVQPVRRRKAHNSGEDSDLKQRRRSRSRCNTSSGSESENSNREYRKKRNRIRQENDMVDSAPQWEAVLRRQKEKNQADPNNRRSRHRSRSRSPDIQAKEELWKHIQKELVDPSGLSEEQLKEIPYTKIETQGDPIRIRHSHSPRSYRQYRRSQCSDGERSVLSEVNSKTDLVPPLPVTRSSDAQGSGDATVHQRRNGSKDSLMEEKPQTSTNNLAGKHTAKTIKTIQASRLKTET

SEQ ID NO: 28096 - protein, 686 aa, Homo sapiens; identical to SEQ ID NO: 28095
  Payload ID: 5532
  Gene Symbol: EPB41L4A
  Gene Name: erythrocyte membrane protein band 4.1 like 4A
  Uniprot ID: Q9HCS5
  ENSP ID: ENSP00000482810

SEQ ID NO: 28097 - protein, 518 aa, Homo sapiens
  Payload ID: 5533
  Gene Symbol: EPB41L4B
  Gene Name: erythrocyte membrane protein band 4.1 like 4B
  Uniprot ID: Q9H329
  ENSP ID: ENSP00000363685
MLRFLRRTFGRRSMQRYARGAAGRGAAGLGDERDGGPRGGPAAAASSSALPAAPGGSVFPAGGGPLLTGGAAVHISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVRPSFQDDRSHWKASASGDDSHFDYVHDQNQKNLGGMQSMMYRDKLMTAL

SEQ ID NO: 28098 - protein, 900 aa, Homo sapiens
  Payload ID: 5533
  Gene Symbol: EPB41L4B
  Gene Name: erythrocyte membrane protein band 4.1 like 4B
  Uniprot ID: Q9H329
  ENSP ID: ENSP00000363694
MLRFLRRTFGRRSMQRYARGAAGRGAAGLGDERDGGPRGGPAAAASSSALPAAPGGSVFPAGGGPLLTGGAAVHISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVSYPLPSPVLSSSDRLPFGIEENGGTPFLTAASGRHHHQHQHQHQHQHHSNYSLSLTLENKEGPLRSPNSSSKSLTKLSPGTPALFSEAAAHLKKLELETVKAAGPWPPLHININKAEEKKVSEKTLQTPLLPSPVADHVKCNILKAQLENASRVNIQGGKEESPFVNINKKSSLQDASVRSPIPIRVETAQPAVEKPEIKPPRVRKLTRQYSFDEDDLPPDLAEAVGVTTSTTTNTTTAATQVSVPLPSPKVQNVSSPHKSEGKGLLSPGAKSPSDRGGAFTLEPGDLLMDFTEATPLAEPASNPHCAHSRCSPPLSLPMKEETTGVCMYPPIKTRLIKTFPVDTMNPFPDTFTTGPQFTADFRDSKLQCCPGPTSPLIPAATLRPLTETVSTVQTIYTTRKPVSLAASAETLRQELEREKMMKRLLMTEL

SEQ ID NO: 28099 - protein, 733 aa, Homo sapiens
  Payload ID: 5534
  Gene Symbol: EPB41L5
  Gene Name: erythrocyte membrane protein band 4.1 like 5
  Uniprot ID: Q9HCM4
  ENSP ID: ENSP00000263713
MLSFFRRTLGRRSMRKHAEKERLREAQRAATHIPAAGDSKSIITCRVSLLDGTDVSVDLPKKAKGQELFDQIMYHLDLIESDYFGLRFMDSAQVAHWLDGTKSIKKQVKIGSPYCLHLRVKFYSSEPNNLREELTRYLFVLQLKQDILSGKLDCPFDTAVQLAAYNLQAELGDYDLAEHSPELVSEFRFVPIQTEEMELAIFEKWKEYRGQTPAQAETNYLNKAKWLEMYGVDMHVVKARDGNDYSLGLTPTGVLVFEGDTKIGLFFWPKITRLDFKKNKLTLVVVEDDDQGKEQEHTFVFRLDHPKACKHLWKCAVEHHAFFRLRGPVQKSSHRSGFIRLGSRFRYSGKTEYQTTKTNKARRSTSFERRPSKRYSRRTLQMKACATKPEELSVHNNVSTQSNGSQQAWGMRSALPVSPSISSAPVPVEIENLPQSPGTDQHDRKCIPLNIDLLNSPDLLEATIGDVIGASDTMETSQALNDVNVATRLPGLGEPEVEYETLKDTSEKLKQLEMENSPLLSPRSNIDVNINSQEEVVKLTEKCLNNVIESPGLNVMRVPPDFKSNILKAQVEAVHKVTKEDSLLSHKNANVQDAATNSAVLNENNVPLPKESLETLMLITPADSGSVLKEATDELDALLASLTENLIDHTVAPQVSSTSMITPRWIVPQSGAMSNGLAGCEMLLTGKEGHGNKDGISLISPPAPFLVDAVTSSGPILAEEAVLKQKCLLTTEL

SEQ ID NO: 28100 - protein, 505 aa, Homo sapiens
  Payload ID: 5534
  Gene Symbol: EPB41L5
  Gene Name: erythrocyte membrane protein band 4.1 like 5
  Uniprot ID: Q9HCM4
  ENSP ID: ENSP00000329687
MLSFFRRTLGRRSMRKHAEKERLREAQRAATHIPAAGDSKSIITCRVSLLDGTDVSVDLPKKAKGQELFDQIMYHLDLIESDYFGLRFMDSAQVAHWLDGTKSIKKQVKIGSPYCLHLRVKFYSSEPNNLREELTRYLFVLQLKQDILSGKLDCPFDTAVQLAAYNLQAELGDYDLAEHSPELVSEFRFVPIQTEEMELAIFEKWKEYRGQTPAQAETNYLNKAKWLEMYGVDMHVVKARDGNDYSLGLTPTGVLVFEGDTKIGLFFWPKITRLDFKKNKLTLVVVEDDDQGKEQEHTFVFRLDHPKACKHLWKCAVEHHAFFRLRGPVQKSSHRSGFIRLGSRFRYSGKTEYQTTKTNKARRSTSFERRPSKRYSRRTLQMKACATKPEELSVHNNVSTQSNGSQQAWGMRSALPVSPSISSAPVPVEIENLPQSPGTDQHDRKWLSAASDCCQRGGNQWNTRALPPPQTAHRNYTDFVHEHNVKNAGIRHDVHFPGHTAMTEI

SEQ ID NO: 28101 - protein, 732 aa, Homo sapiens
  Payload ID: 5534
  Gene Symbol: EPB41L5
  Gene Name: erythrocyte membrane protein band 4.1 like 5
  Uniprot ID: Q9HCM4
  ENSP ID: ENSP00000390439
MLSFFRRTLGRRSMRKHAEKERLREAQRAATHIPAAGDSKSIITCRVSLLDGTDVSVDLPKKAKGQELFDQIMYHLDLIESDYFGLRFMDSAQVAHWLDGTKSIKKQVKIGSPYCLHLRVKFYSSEPNNLREELTRYLFVLQLKQDILSGKLDCPFDTAVQLAAYNLQAELGDYDLAEHSPELVSEFRFVPIQTEEMELAIFEKWKEYRGQTPAQAETNYLNKAKWLEMYGVDMHVVKARDGNDYSLGLTPTGVLVFEGDTKIGLFFWPKITRLDFKKNKLTLVVVEDDDQGKEQEHTFVFRLDHPKACKHLWKCAVEHHAFFRLRGPVQKSSHRSGFIRLGSRFRYSGKTEYQTTKTNKARRSTSFERRPSKRYSRRTLQMKACATKPEELSVHNNVSTQSNGSQQAWGMRSALPVSPSISSAPVPVEIENLPQSPGTDQHDRKCIPLNIDLLNSPDLLEATIGDVIGASDTMETSQALNDVNVATRLPGLGEPEVEYETLKDTSEKLKQLEMENSPLLSPRSNIDVNINSQEEVVKLTEKCLNNVIESPGLNVMRVPPDFKSNILKAQVEAVHKVTKEDSLLSHKNANVQDAATNSAVLNENNVPLPKESLETLMLITPADSGSVLKEATDELDALLASLTENLIDHTVAPQVSSTSMITPRWIVPSGAMSNGLAGCEMLLTGKEGHGNKDGISLISPPAPFLVDAVTSSGPILAEEAVLKQKCLLTTEL

SEQ ID NO: 28102 - protein, 505 aa, Homo sapiens; identical to SEQ ID NO: 28100
  Payload ID: 5534
  Gene Symbol: EPB41L5
  Gene Name: erythrocyte membrane protein band 4.1 like 5
  Uniprot ID: Q9HCM4
  ENSP ID: ENSP00000393722

SEQ ID NO: 28103 - protein, 687 aa, Homo sapiens
  Payload ID: 5534
  Gene Symbol: EPB41L5
  Gene Name: erythrocyte membrane protein band 4.1 like 5
  Uniprot ID: Q9HCM4
  ENSP ID: ENSP00000393856
MLSFFRRTLGRRSMRKHAEKERLREAQRAATHIPAAGDSKSIITCRVSLLDGTDVSVDLPKKAKGQELFDQIMYHLDLIESDYFGLRFMDSAQVAHWLDGTKSIKKQVKIGSPYCLHLRVKFYSSEPNNLREELTRYLFVLQLKQDILSGKLDCPFDTAVQLAAYNLQAELGDYDLAEHSPELVSEFRFVPIQTEEMELAIFEKWKEYRGQTPAQAETNYLNKAKWLEMYGVDMHVVKARDGNDYSLGLTPTGVLVFEGDTKIGLFFWPKITRLDFKKNKLTLVVVEDDDQGKEQEHTFVFRLDHPKACKHLWKCAVEHHAFFRLRGPVQKSSHRSGFIRLGSRFRYSGKTEYQTTKTNKARRSTSFERRPSKRYSRRTLQMKACATKPEELSVHNNVSTQSNGSQQAWGMRSALPVSPSISSAPVPVEIENLPQSPGTDQHDRKCIPLNIDLLNSPDLLEATIGDVIGASDTMETSQALNDVNVATRLPGLGEPEVEYETLKDTSEKLKQLEMENSPLLSPRSNIDVNINSQEEVVKLTEKCLNNVIESPGLNVMRVPPDFKSNILKAQVEAVHKVTKEDSLLSHKNANVQDAATNSAVLNENNVPLPKESLETLMLITPADSGSVLKEATDELDALLASLTENLIDHTVAPQVSSTSMITPRWIVPLWSHFGRRSCPEAEVFTDH

SEQ ID NO: 28104 - protein, 779 aa, Homo sapiens
  Payload ID: 5535
  Gene Symbol: EPB41L1
  Gene Name: erythrocyte membrane protein band 4.1-like 1
  Uniprot ID: Q9H4G0
  ENSP ID: ENSP00000202028
MEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 28105 - protein, 881 aa, Homo sapiens
  Payload ID: 5535
  Gene Symbol: EPB41L1
  Gene Name: erythrocyte membrane protein band 4.1-like 1
  Uniprot ID: Q9H4G0
  ENSP ID: ENSP00000337168
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKPEQETTPRHKQEFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 28106 - protein, 880 aa, Homo sapiens
  Payload ID: 5535
  Gene Symbol: EPB41L1
  Gene Name: erythrocyte membrane protein band 4.1-like 1
  ENSP ID: ENSP00000363052
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKPEQETTPRHKQEFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 28107 - protein, 199 aa, Homo sapiens
  Payload ID: 5535
  Gene Symbol: EPB41L1
  Gene Name: erythrocyte membrane protein band 4.1-like 1
  ENSP ID: ENSP00000363056
MEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTY

SEQ ID NO: 28108 - protein, 880 aa, Homo sapiens; identical to SEQ ID NO: 28106
  Payload ID: 5535
  Gene Symbol: EPB41L1
  Gene Name: erythrocyte membrane protein band 4.1-like 1
  ENSP ID: ENSP00000363057

SEQ ID NO: 28109 - protein, 772 aa, Homo sapiens
  Payload ID: 5535
  Gene Symbol: EPB41L1
  Gene Name: erythrocyte membrane protein band 4.1-like 1
  Uniprot ID: Q9H4G0
  ENSP ID: ENSP00000363061
MEEKDYSEADGLSERTTPSKAQKSPQKIAKKYKSAICRVTLLDASEYECEVENWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 28110 - protein, 168 aa, Homo sapiens
  Payload ID: 5535
  Gene Symbol: EPB41L1
  Gene Name: erythrocyte membrane protein band 4.1-like 1
  ENSP ID: ENSP00000385244
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWN

SEQ ID NO: 28111 - protein, 197 aa, Homo sapiens
  Payload ID: 5535
  Gene Symbol: EPB41L1
  Gene Name: erythrocyte membrane protein band 4.1-like 1
  ENSP ID: ENSP00000388281
VLLKHQASINELKRTLKEPNSKLIHRDRDWERERRLPSSPASPSPKGTPEKANEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDV

SEQ ID NO: 28112 - protein, 119 aa, Homo sapiens
  Payload ID: 5535
  Gene Symbol: EPB41L1
  Gene Name: erythrocyte membrane protein band 4.1-like 1
  ENSP ID: ENSP00000390262
  MOD_RES (1)..(1): Any amino acid
XSVGREFIATTPSITTETISTTMIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 28113 - protein, 37 aa, Homo sapiens
  Payload ID: 5535
  Gene Symbol: EPB41L1
  Gene Name: erythrocyte membrane protein band 4.1-like 1
  ENSP ID: ENSP00000393106
MEEKDYSEADGLSERTTPSKAQKSPQKIAKKYKSAIC

SEQ ID NO: 28114 - protein, 114 aa, Homo sapiens
  Payload ID: 5535
  Gene Symbol: EPB41L1
  Gene Name: erythrocyte membrane protein band 4.1-like 1
  ENSP ID: ENSP00000396366
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVE

SEQ ID NO: 28115 - protein, 779 aa, Homo sapiens; identical to SEQ ID NO: 28104
  Payload ID: 5535
  Gene Symbol: EPB41L1
  Gene Name: erythrocyte membrane protein band 4.1-like 1
  Uniprot ID: Q9H4G0
  ENSP ID: ENSP00000399214

SEQ ID NO: 28116 - protein, 257 aa, Homo sapiens
  Payload ID: 5535
  Gene Symbol: EPB41L1
  Gene Name: erythrocyte membrane protein band 4.1-like 1
  ENSP ID: ENSP00000404341
MEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRF

SEQ ID NO: 28117 - protein, 268 aa, Homo sapiens
  Payload ID: 5535
  Gene Symbol: EPB41L1
  Gene Name: erythrocyte membrane protein band 4.1-like 1
  ENSP ID: ENSP00000406464
  MOD_RES (1)..(1): Any amino acid
XRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANEPVKTETMTVSSLAIRKKIEPEAVLQTRVSAMDNTQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQ

SEQ ID NO: 28118 - protein, 59 aa, Homo sapiens
  Payload ID: 5535
  Gene Symbol: EPB41L1
  Gene Name: erythrocyte membrane protein band 4.1-like 1
  ENSP ID: ENSP00000408877
MTTETGPDSEVKKAQEEAPQQPEAAAAVTTPVTPAGHGHPEANSNEKHPSQQDTRPAEQ

SEQ ID NO: 28119 - protein, 188 aa, Homo sapiens
  Payload ID: 5535
  Gene Symbol: EPB41L1
  Gene Name: erythrocyte membrane protein band 4.1-like 1
  ENSP ID: ENSP00000413262
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDIT

SEQ ID NO: 28120 - protein, 701 aa, Homo sapiens
  Payload ID: 5535
  Gene Symbol: EPB41L1
  Gene Name: erythrocyte membrane protein band 4.1-like 1
  Uniprot ID: Q9H4G0
  ENSP ID: ENSP00000487049
MVFLGRINEVEPAKGLAESLAPTERSVKSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 28121 - protein, 1005 aa, Homo sapiens
  Payload ID: 5536
  Gene Symbol: EPB41L2
  Gene Name: erythrocyte membrane protein band 4.1-like 2
  Uniprot ID: O43491
  ENSP ID: ENSP00000338481
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKKNSLRVEGDNIYVRHSNLMLEELDKAQEDILKHQASISELKRNFMESTPEPRPNEWEKRRITPLSLQTQGSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQDMGEEAEEEPQKVNGEVSHVDIDVLPQIICCSEPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 28122 - protein, 1005 aa, Homo sapiens; identical to SEQ ID NO: 28121
  Payload ID: 5536
  Gene Symbol: EPB41L2
  Gene Name: erythrocyte membrane protein band 4.1-like 2
  Uniprot ID: O43491
  ENSP ID: ENSP00000357110

SEQ ID NO: 28123 - protein, 673 aa, Homo sapiens
  Payload ID: 5536
  Gene Symbol: EPB41L2
  Gene Name: erythrocyte membrane protein band 4.1-like 2
  Uniprot ID: O43491
  ENSP ID: ENSP00000376222
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKTVKGGISETRIEKRIVITGDGDIDHDQALAQAIREAREQHPDMSVTRVVVHKETELAEEGED

SEQ ID NO: 28124 - protein, 380 aa, Homo sapiens
  Payload ID: 5536
  Gene Symbol: EPB41L2
  Gene Name: erythrocyte membrane protein band 4.1-like 2
  ENSP ID: ENSP00000397580
  MOD_RES (1)..(1): Any amino acid
XLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKKNSLRVEGDNIYVRHSNLMLEELDKAQEDILKHQASISELKRNFMESTPEPRPNEWEKRRITPLSLQTQGRKGDHLFKDILSVKEKYLMPTIWTVEEKAQETDKTRAPESEGPCTGARDAVKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQD

SEQ ID NO: 28125 - protein, 747 aa, Homo sapiens
  Payload ID: 5536
  Gene Symbol: EPB41L2
  Gene Name: erythrocyte membrane protein band 4.1-like 2
  Uniprot ID: O43491
  ENSP ID: ENSP00000402041
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 28126 - protein, 811 aa, Homo sapiens
  Payload ID: 5536
  Gene Symbol: EPB41L2
  Gene Name: erythrocyte membrane protein band 4.1-like 2
  ENSP ID: ENSP00000431647
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 28127 - protein, 706 aa, Homo sapiens
  Payload ID: 5536
  Gene Symbol: EPB41L2
  Gene Name: erythrocyte membrane protein band 4.1-like 2
  ENSP ID: ENSP00000431988
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 28128 - protein, 162 aa, Homo sapiens
  Payload ID: 5536
  Gene Symbol: EPB41L2
  Gene Name: erythrocyte membrane protein band 4.1-like 2
  ENSP ID: ENSP00000432013
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVE

SEQ ID NO: 28129 - protein, 153 aa, Homo sapiens
  Payload ID: 5536
  Gene Symbol: EPB41L2
  Gene Name: erythrocyte membrane protein band 4.1-like 2
  ENSP ID: ENSP00000432329
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKE

SEQ ID NO: 28130 - protein, 673 aa, Homo sapiens; identical to SEQ ID NO: 28123
  Payload ID: 5536
  Gene Symbol: EPB41L2
  Gene Name: erythrocyte membrane protein band 4.1-like 2
  Uniprot ID: O43491
  ENSP ID: ENSP00000432803

SEQ ID NO: 28131 - protein, 240 aa, Homo sapiens
  Payload ID: 5536
  Gene Symbol: EPB41L2
  Gene Name: erythrocyte membrane protein band 4.1-like 2
  ENSP ID: ENSP00000432949
MEEEETQLEEELDKAQEDILKHQASISELKRNFMESTPEPRPNEWEKRRITPLSLQTQGSLEEEITSILFSEKGFSDSMKATFTSATTWTAEGAVVSANAPSEKLSSSPFSHLLETRAPESEGPCTGARDAVKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAI

SEQ ID NO: 28132 - protein, 747 aa, Homo sapiens; identical to SEQ ID NO: 28125
  Payload ID: 5536
  Gene Symbol: EPB41L2
  Gene Name: erythrocyte membrane protein band 4.1-like 2
  Uniprot ID: O43491
  ENSP ID: ENSP00000434308

SEQ ID NO: 28133 - protein, 852 aa, Homo sapiens
  Payload ID: 5536
  Gene Symbol: EPB41L2
  Gene Name: erythrocyte membrane protein band 4.1-like 2
  Uniprot ID: O43491
  ENSP ID: ENSP00000434576
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 28134 - protein, 126 aa, Homo sapiens
  Payload ID: 5536
  Gene Symbol: EPB41L2
  Gene Name: erythrocyte membrane protein band 4.1-like 2
  ENSP ID: ENSP00000434596
MEEEETQLEEKNSLRVEGDNIYVRHSNLMLEIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 28135 - protein, 224 aa, Homo sapiens
  Payload ID: 5536
  Gene Symbol: EPB41L2
  Gene Name: erythrocyte membrane protein band 4.1-like 2
  ENSP ID: ENSP00000434998
MEEEETQLEEELDKAQEDILKHQASISELKRNFMESTPEPRPNEWEKRRITPLSLQTQGSLEEEITSILFSEKGFSDSMKATFTSATTWTAEGAVVSANAPSEKLSSSPFSHLLETRAPESEGPCTGARDAVKSSHETLNIVEEKKRAEVGKDERVITEEMNGKEISPGSGPGEIRKVEPVTQKDSTSLSSESSSSSSESEEEDVGEYRPHHRVTEGTIREEQE

SEQ ID NO: 28136 - protein, 118 aa, Homo sapiens
  Payload ID: 5536
  Gene Symbol: EPB41L2
  Gene Name: erythrocyte membrane protein band 4.1-like 2
  ENSP ID: ENSP00000435556
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPL

SEQ ID NO: 28137 - protein, 127 aa, Homo sapiens
  Payload ID: 5536
  Gene Symbol: EPB41L2
  Gene Name: erythrocyte membrane protein band 4.1-like 2
  ENSP ID: ENSP00000436145
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKG

SEQ ID NO: 28138 - protein, 935 aa, Homo sapiens
  Payload ID: 5536
  Gene Symbol: EPB41L2
  Gene Name: erythrocyte membrane protein band 4.1-like 2
  ENSP ID: ENSP00000436348
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQDMGEEAEEEPQKVNGEVSHVDIDVLPQIICCSEPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 28139 - protein, 201 aa, Homo sapiens
  Payload ID: 5536
  Gene Symbol: EPB41L2
  Gene Name: erythrocyte membrane protein band 4.1-like 2
  ENSP ID: ENSP00000436349
MEEEETQLEEKNSLRVEGDNIYVRHSNLMLEELDKAQEDILKHQASISELKRNFMESTPEPRPNEWEKRRITPLSLQTQGTRAPESEGPCTGARDAVKPPVVKTEMVTISDASQRTEISTKEVPIVQTETKTITYESPQTVKGGISETRIEKRIVITGDGDIDHDQALAQAIREAREQHPDMSVTRVVVHKETELAEEGED

SEQ ID NO: 28140 - protein, 935 aa, Homo sapiens; identical to SEQ ID NO: 28138
  Payload ID: 5536
  Gene Symbol: EPB41L2
  Gene Name: erythrocyte membrane protein band 4.1-like 2
  ENSP ID: ENSP00000436641

SEQ ID NO: 28141 - protein, 179 aa, Homo sapiens
  Payload ID: 5536
  Gene Symbol: EPB41L2
  Gene Name: erythrocyte membrane protein band 4.1-like 2
  ENSP ID: ENSP00000436871
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKE

SEQ ID NO: 28142 - protein, 383 aa, Homo sapiens
  Payload ID: 5536
  Gene Symbol: EPB41L2
  Gene Name: erythrocyte membrane protein band 4.1-like 2
  ENSP ID: ENSP00000437207
MEEEETQLEEELDKAQEDILKHQASISELKRNFMESTPEPRPNEWEKRRITPLSLQTQGSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQDMGEEAEEEPQKVNGEVSHVDIDVLPQIICCSEPPVVKTEMVTISDASQRTEISTKEVPIVQTETKTITYESPQIDGGAGGDSGTLLTAQTITSESVSTTTTTHITKTVKGGISETRIEKRIVITGDGDIDHDQALAQAIREAREQHPDMSVTRVVVHKETELAEEGED

SEQ ID NO: 28143 - protein, 268 aa, Homo sapiens
  Payload ID: 5536
  Gene Symbol: EPB41L2
  Gene Name: erythrocyte membrane protein band 4.1-like 2
  ENSP ID: ENSP00000437295
MEEEETQLEEKNSLRVEGDNIYVRHSNLMLEELDKAQEDILKHQASISELKRNFMESTPEPRPNEWEKRRITPLSLQTQGSSHETLNIVEEKKRAEVGKDERVITEEMNGKEISPGSGPGEIRKVEPVTQKDSTSLSSESSSSSSESEEEDVGEYRPHHRVTEGTIREEQEYEEEVEEEPRPAAKVVEREEAVPEASPVTQAGASVITVETVIQENVGAQKIPGEKSVHEGALKQDMGEEAEEEPQKVNGEVSHVDIDVLPQIICCSE

SEQ ID NO: 28144 - protein, 633 aa, Homo sapiens
  Payload ID: 5536
  Gene Symbol: EPB41L2
  Gene Name: erythrocyte membrane protein band 4.1-like 2
  ENSP ID: ENSP00000477544
MTTEVGSVSEVKKDSSQLGTDATKEKPKEVAENQQNQSSDPEEEKGSQPPPAAESQSSLRRQKREKETSESRGISRFIPPWLKKQKSYTLVVAKDGGDKKEPTQAVVEEQVLDKEEPLPEEQRQAKGDAEEMAQKKQEIKVEVKEEKPSVSKEEKPSVSKVEMQPTELVSKEREEKVKETQEDKLEGGAAKRETKEVQTNELKAEKASQKVTKKTKTVQCKVTLLDGTEYSCDLEKHAKGQVLFDKVCEHLNLLEKDYFGLLFQESPEQKNWLDPAKEIKRQLRNLPWLFTFNVKFYPPDPSQLTEDITRYFLCLQLRQDIASGRLPCSFVTHALLGSYTLQAELGDYDPEEHGSIDLSEFQFAPTQTKELEEKVAELHKTHRGLSPAQADSQFLENAKRLSMYGVDLHHAKDSEGVDIKLGVCANGLLIYKDRLRINRFAWPKILKISYKRSNFYIKVRPAELEQFESTIGFKLPNHRAAKRLWKVCVEHHTFYRLVSPEQPPKAKFLTLGSKFRYSGRTQAQTRQASTLIDRPAPHFERTSSKRVSRSLDGAPIGVMDQSLMKDFPGAAGEISAYGPGLVSIAVVQDGDGRREVRSPTKAPHLQLIEGKSSHETLNIVEEKSGQRLGKTKE

SEQ ID NO: 28145 - protein, 935 aa, Homo sapiens; identical to SEQ ID NO: 28138
  Payload ID: 5536
  Gene Symbol: EPB41L2
  Gene Name: erythrocyte membrane protein band 4.1-like 2
  ENSP ID: ENSP00000486691

SEQ ID NO: 28146 - protein, 918 aa, Homo sapiens
  Payload ID: 5537
  Gene Symbol: EPB41L3
  Gene Name: erythrocyte membrane protein band 4.1-like 3
  ENSP ID: ENSP00000341138
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGASVNENHEIYMKDSMSAAEVGTGQYATTKGISQTNLITTVTPEKKAEEERDEEEDKRRKGEEVTPISAIRHEGKTDSERTDTAADGETTATESDQEEDAELKAQELEKTQDDLMKHQTNISELKRTFLETSTDTAVTNEWEKRLSTSPVRLAARQEDAPMIEPLVPEETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 28147 - protein, 1087 aa, Homo sapiens
  Payload ID: 5537
  Gene Symbol: EPB41L3
  Gene Name: erythrocyte membrane protein band 4.1-like 3
  Uniprot ID: Q9Y2J2
  ENSP ID: ENSP00000343158
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGEVGTGQYATTKGISQTNLITTVTPEKKAEEERDEEEDKRRKGEEVTPISAIRHEGKSPGLGTDSCPLSPPSTHCAPTSPTELRRRCKENDCKLPGYEPSRAEHLPGEPALDSDGPGRPYLGDQDVAFSYRQQTGKGTTLFSFSLQLPESFPSLLDDDGYLSFPNLSETNLLPQSLQHYLPIRSPSLVPCFLFIFFFLLSASFSVPYALTLSFPLALCLCYLEPKAASLSASLDNDPSDSSEEETDSERTDTAADGETTATESDQEEDAELKAQELEKTQDDLMKHQTNISELKRTFLETSTDTAVTNEWEKRLSTSPVRLAARQEDAPMIEPLVPEETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 28148 - protein, 503 aa, Homo sapiens
  Payload ID: 5537
  Gene Symbol: EPB41L3
  Gene Name: erythrocyte membrane protein band 4.1-like 3
  ENSP ID: ENSP00000382981
MQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGASVNENHEIYMKDSMSAAEVGTGQYATTKGISQTNLITTVTPEKKAEEERDEEEDKRRKGEEVTPISAIRHEGKTDSERTDTAADGETTATEELEKTQDDLMKHQTNISELKRTFLETSTDTAVTNEWEKRLSTSPVRLAARQEDAPMIEPLVPEEKMETKTESSG

SEQ ID NO: 28149 - protein, 883 aa, Homo sapiens
  Payload ID: 5537
  Gene Symbol: EPB41L3
  Gene Name: erythrocyte membrane protein band 4.1-like 3
  Uniprot ID: Q9Y2J2
  ENSP ID: ENSP00000441174
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGASVNENHEIYMKDSMSAAEVGTGQYATTKGISQTNLITTVTPEKKAEEERDEEEDKRRKGEEVTPISAIRHEGKTDSERTDTAADGETTATESDQEEDAELKAQELEKTQDDLMKHQTNISELKRTFLETSTDTAVTNEWEKRLSTSPVRLAARQEDAPMIEPLVPEETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQE

SEQ ID NO: 28150 - protein, 865 aa, Homo sapiens
  Payload ID: 5537
  Gene Symbol: EPB41L3
  Gene Name: erythrocyte membrane protein band 4.1-like 3
  Uniprot ID: Q9Y2J2
  ENSP ID: ENSP00000442091
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGASVNENHEIYMKDSMSAAEVGTGQYATTKGISQTNLITTVTPEKKAEEERDEEEDKRRKGEEVTPISAIRHEGKTDSERTDTAADGETTATEELEKTQDDLMKHQTNISELKRTFLETSTDTAVTNEWEKRLSTSPVRLAARQEDAPMIEPLVPEEKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 28151 - protein, 116 aa, Homo sapiens
  Payload ID: 5537
  Gene Symbol: EPB41L3
  Gene Name: erythrocyte membrane protein band 4.1-like 3
  ENSP ID: ENSP00000461937
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVIL

SEQ ID NO: 28152 - protein, 90 aa, Homo sapiens
  Payload ID: 5537
  Gene Symbol: EPB41L3
  Gene Name: erythrocyte membrane protein band 4.1-like 3
  ENSP ID: ENSP00000462338
MTTESGSDSESKPDQEAEPQEAAGAQGRAGAPVPEPPKEEQQQALEQFAAAAAHSTPVRREVTDKEQEFAARAAKQLEYQQLEDDKLSQK

SEQ ID NO: 28153 - protein, 162 aa, Homo sapiens
  Payload ID: 5537
  Gene Symbol: EPB41L3
  Gene Name: erythrocyte membrane protein band 4.1-like 3
  ENSP ID: ENSP00000462692
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQK

SEQ ID NO: 28154 - protein, 147 aa, Homo sapiens
  Payload ID: 5537
  Gene Symbol: EPB41L3
  Gene Name: erythrocyte membrane protein band 4.1-like 3
  ENSP ID: ENSP00000462783
MFLVFSMTDIFHFEQFESTIGFKLPNHRAAKRLWKVCVEHHTFFRLLLPEAPPKKFLTLGSKFRYSGRTQAQTRRASALIDRPAPYFERSSSKRYTMSRSLDGASVNENHEIYMKDSMSAAEVGTGQYATTKGISQTNLITTVTPEK

SEQ ID NO: 28155 - protein, 125 aa, Homo sapiens
  Payload ID: 5537
  Gene Symbol: EPB41L3
  Gene Name: erythrocyte membrane protein band 4.1-like 3
  ENSP ID: ENSP00000463122
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCD

SEQ ID NO: 28156 - protein, 113 aa, Homo sapiens
  Payload ID: 5537
  Gene Symbol: EPB41L3
  Gene Name: erythrocyte membrane protein band 4.1-like 3
  ENSP ID: ENSP00000463289
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCK

SEQ ID NO: 28157 - protein, 96 aa, Homo sapiens
  Payload ID: 5537
  Gene Symbol: EPB41L3
  Gene Name: erythrocyte membrane protein band 4.1-like 3
  ENSP ID: ENSP00000463707
MPSFICLYLCSKSLLGFGEQSTMTTESGSDSESKPDQEAEPQEAAGAQGRAGAPVPEPPKEEQQQALEQFAAAAAHSTPVRREVTDKEQEFAARAA

SEQ ID NO: 28158 - protein, 127 aa, Homo sapiens
  Payload ID: 5537
  Gene Symbol: EPB41L3
  Gene Name: erythrocyte membrane protein band 4.1-like 3
  ENSP ID: ENSP00000464020
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVE

SEQ ID NO: 28159 - protein, 127 aa, Homo sapiens; identical to SEQ ID NO: 28158
  Payload ID: 5537
  Gene Symbol: EPB41L3
  Gene Name: erythrocyte membrane protein band 4.1-like 3
  ENSP ID: ENSP00000464148

SEQ ID NO: 28160 - protein, 79 aa, Homo sapiens
  Payload ID: 5537
  Gene Symbol: EPB41L3
  Gene Name: erythrocyte membrane protein band 4.1-like 3
  ENSP ID: ENSP00000464336
MTTESGSDSESKPDQEAEPQEAAGAQGRAGAPVPEPPKEEQQQALEQFAAAAAHSTPVRREVTDKEQEFAARAAKQLEY

SEQ ID NO: 28161 - protein, 162 aa, Homo sapiens; identical to SEQ ID NO: 28153
  Payload ID: 5537
  Gene Symbol: EPB41L3
  Gene Name: erythrocyte membrane protein band 4.1-like 3
  ENSP ID: ENSP00000464533

SEQ ID NO: 28162 - protein, 110 aa, Homo sapiens
  Payload ID: 5537
  Gene Symbol: EPB41L3
  Gene Name: erythrocyte membrane protein band 4.1-like 3
  ENSP ID: ENSP00000464570
SSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQVVCVRR

SEQ ID NO: 28163 - protein, 188 aa, Homo sapiens
  Payload ID: 5537
  Gene Symbol: EPB41L3
  Gene Name: erythrocyte membrane protein band 4.1-like 3
  ENSP ID: ENSP00000487780
  MOD_RES (1)..(1): Any amino acid
XYTMSRSLDGASVNENHEIYMKDSMSAAEVGTGQYATTKGISQTNLITTVTPEKKAEEERDEEEDKRRKGEEVTPISAIRHEGKTDSERTDTAADGETTATESDQEEDAELKAQELEKTQDDLMKHQTNISELKRTFLETSTDTAVTNEWEKRLSTSPVRLAARQEDAPMIEPLVPEETKQSSGEKLM

SEQ ID NO: 28164 - protein, 183 aa, Homo sapiens
  Payload ID: 5537
  Gene Symbol: EPB41L3
  Gene Name: erythrocyte membrane protein band 4.1-like 3
  ENSP ID: ENSP00000487786
KAEEERDEEEDKRRKGEEVTPISAIRHEGKELEKTQDDLMKHQTNISELKRTFLETSTDTAVTNEWEKRLSTSPVRLAARQEDAPMIEPLVPEEKMETKTESSGIETEPTVHHLPLSTEKVVQETVLVEERRVVHASGDASYSAGDSGDAAAQPAFTGIKGKEGSALTEGAKEEGGEEVAKAV

SEQ ID NO: 28165 - protein, 194 aa, Homo sapiens
  Payload ID: 5537
  Gene Symbol: EPB41L3
  Gene Name: erythrocyte membrane protein band 4.1-like 3
  ENSP ID: ENSP00000487915
VTPEKKAEEERDEEEDKRRKGEEVTPISAIRHEGKTDSERTDTAADGETTATEELEKTQDDLMKHQTNISELKRTFLETSTDTAVTNEWEKRLSTSPVRLAARQEDAPMIEPLVPEETKEETEISEKVIFLQQGSAPFLESQTKQSSGEKLMDGSEIFSLLESARKPTEFIGGVTSTSQSWVQKMETKTESSGI

SEQ ID NO: 28166 - protein, 189 aa, Homo sapiens
  Payload ID: 5537
  Gene Symbol: EPB41L3
  Gene Name: erythrocyte membrane protein band 4.1-like 3
  ENSP ID: ENSP00000488037
EEERDEEEDKRRKGEEVTPISAIRHEGKTDSERTDTAADGETTATEELEKTQDDLMKHQTNISELKRTFLETSTDTAVTNEWEKRLSTSPVRLAARQEDAPMIEPLVPEEVSSQTKEETEISEKVIFLQQGSAPFLESQTKQSSGEKLMDGSEIFSLLESARKPTEFIGGVTSTSQSWVQKMETKTESS

SEQ ID NO: 28167 - protein, 197 aa, Homo sapiens
  Payload ID: 5537
  Gene Symbol: EPB41L3
  Gene Name: erythrocyte membrane protein band 4.1-like 3
  ENSP ID: ENSP00000488095
  MOD_RES (1)..(1): Any amino acid
XKAEEERDEEEDKRRKGEEVTPISAIRHEGKTDSERTDTAADGETTATEELEKTQDDLMKHQTNISELKRTFLETSTDTAVTNEWEKRLSTSPVRLAARQEDAPMIEPLVPEEPSVIKKMQEGDSADSVVTSRQIIFQKTVPSTLETKQSSGEKLMDGSEIFSLLESARKPTEFIGGVTSTSQSWVQKMETKTESSG

SEQ ID NO: 28168 - protein, 756 aa, Homo sapiens
  Payload ID: 5537
  Gene Symbol: EPB41L3
  Gene Name: erythrocyte membrane protein band 4.1-like 3
  ENSP ID: ENSP00000488626
MQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGASVNENHEIYMKDSMSAAEVGTGQYATTKGISQTNLITTVTPEKKAEEERDEEEDKRRKGEEVTPISAIRHEGKTDSERTDTAADGETTATEELEKTQDDLMKHQTNISELKRTFLETSTDTAVTNEWEKRLSTSPVRLAARQEDAPMIEPLVPEEKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 28169 - protein, 325 aa, Homo sapiens
  Payload ID: 5537
  Gene Symbol: EPB41L3
  Gene Name: erythrocyte membrane protein band 4.1-like 3
  ENSP ID: ENSP00000488647
  MOD_RES (1)..(1): Any amino acid
XTPEKKAEEERDEEEDKRRKGEEVTPISAIRHEGKTDSERTDTAADGETTATEELEKTQDDLMKHQTNISELKRTFLETSTDTAVTNEWEKRLSTSPVRLAARQEDAPMIEPLVPEETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQ

SEQ ID NO: 28170 - protein, 36 aa, Homo sapiens
  Payload ID: 5537
  Gene Symbol: EPB41L3
  Gene Name: erythrocyte membrane protein band 4.1-like 3
  ENSP ID: ENSP00000489405
  MOD_RES (1)..(1): Any amino acid
XQFAAAAAHSTPVRREVSPGQKTNDAVFAELLQDRL

SEQ ID NO: 28171 - protein, 721 aa, Homo sapiens
  Payload ID: 5538
  Gene Symbol: EPB42
  Gene Name: erythrocyte membrane protein band 4.2
  Uniprot ID: P16452
  ENSP ID: ENSP00000300215
MGQGEPSQRSTGLAGLYAAPAASPVFIKGSGMDALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYRFRSVWPENTMCAKFQFTPTHVGLQRLTVEVDCNMFQNLTNYKSVTVVAPELSA

SEQ ID NO: 28172 - protein, 691 aa, Homo sapiens
  Payload ID: 5538
  Gene Symbol: EPB42
  Gene Name: erythrocyte membrane protein band 4.2
  Uniprot ID: P16452
  ENSP ID: ENSP00000396616
MGQALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYRFRSVWPENTMCAKFQFTPTHVGLQRLTVEVDCNMFQNLTNYKSVTVVAPELSA

SEQ ID NO: 28173 - protein, 613 aa, Homo sapiens
  Payload ID: 5538
  Gene Symbol: EPB42
  Gene Name: erythrocyte membrane protein band 4.2
  ENSP ID: ENSP00000444699
MGQALGIKSCDFQAARNNEEHHTKALSSRRLFVRRGQPFTIILYFRAPVRAFLPALKKVALTAQTEDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYRFRSVWPENTMCAKFQFTPTHVGLQRLTVEVDCNMFQNLTNYKSVTVVAPELSA

SEQ ID NO: 28174 - protein, 191 aa, Homo sapiens
  Payload ID: 5538
  Gene Symbol: EPB42
  Gene Name: erythrocyte membrane protein band 4.2
  ENSP ID: ENSP00000455489
VIGHYSLLLQVSGRKQLLLGQFTLLFNPWNREDAVFLKNEAQRMEYLLNQNGLIYLGTADCIQAESWDFGQLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPA

SEQ ID NO: 28175 - protein, 543 aa, Homo sapiens
  Payload ID: 5538
  Gene Symbol: EPB42
  Gene Name: erythrocyte membrane protein band 4.2
  ENSP ID: ENSP00000457140
PVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWIFQTSTECWMTRPALPQGYDGWQILHPSAPNGGGVLGSCDLVPVRAVKEGTLGLTPAVSDLFAAINASCVVWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLDARESRAVSTPHSLSQPPELPRCPHGGLCDLHPGKGAHSQREELQIPFSVA

SEQ ID NO: 28176 - protein, 147 aa, Homo sapiens
  Payload ID: 5538
  Gene Symbol: EPB42
  Gene Name: erythrocyte membrane protein band 4.2
  ENSP ID: ENSP00000457757
  MOD_RES (1)..(1): Any amino acid
XRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLGNALWPHQTPPDTHTHMAPALGRQQPQGTPCSL

SEQ ID NO: 28177 - protein, 619 aa, Homo sapiens
  Payload ID: 5538
  Gene Symbol: EPB42
  Gene Name: erythrocyte membrane protein band 4.2
  Uniprot ID: P16452
  ENSP ID: ENSP00000481226
MGQALGIKSCDFQAARNNEEHHTKALSSRRLFVRRGQPFTIILYFRAPVRAFLPALKKVALTAQTGEQPSKINRTQATFPISSLGDRKWWSAVVEERDAQSWTISVTTPADAVIGHYSLLLQVSGRKQLLLGQFTLLFNPWNREDAVFLKNEAQRMEYLLNQNGLIYLGTADCIQAESWDFGQFEGDVIDLSLRLLSKDKQVEKWSQPVHVARVLGALLHFLKEQRVLPTPQTQATQEGALLNKRRGSVPILRQWLTGRGRPVYDGQAWVLAAVACTVLRCLGIPARVVTTFASAQGTGGRLLIDEYYNEEGLQNGEGQRGRIWKCCEDGTLELTDSNTKYVGNNISTKGVGSDRCEDITQNYKYPEGSLQEKEVLERVEKEKMEREKDNGIRPPSLETASPLYLLLKAPSSLPLRGDAQISVTLVNHSEQEKAVQLAIGVQAVHYNGVLAAKLWRKKLHLTLSANLEKIITIGLFFSNFERNPPENTFLRLTAMATHSESNLSCFAQEDIAICRPHLAIKMPEKAEQYQPLTASVSLQNSLDAPMEDCVISILGRGLIHRERSYRFRSVWPENTMCAKFQFTPTHVGLQRLTVEVDCNMFQNLTNYKSVTVVAPELSA

SEQ ID NO: 28178 - protein, 1204 aa, Homo sapiens
  Payload ID: 5539
  Gene Symbol: EDRF1
  Gene Name: erythroid differentiation regulatory factor 1
  Uniprot ID: Q3B7T1
  ENSP ID: ENSP00000336727
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGLKNDFVRNILWTFEDIHMLVGSNMPIFGGGRYPAVSLRLRDNNKPINVLTGIDYWLDNLICNVPELVMCFHVNGIVQKYEMIKTEEIPNLENSNFSTKVIKDIAQNILSFLKSNCTKEGHTYWLFKASGSDIVKLYDLTTLCEETEDKYQNPFTMPVAILLYKVACNMMMKKNQNKKHYGTIRTLLLNCLKLLDKSRHPQIIASANYMLSELFQLDEPKKEENSESPLNENSDESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGFAWATDLSTDLESQLSVSCKCYEAANEILQFSDLKSQNPEHYVQVLKRMGNIRNEIGVFYMNQAAALQSERLVSKSVSAAEQQLWKKSFSCFEKGIHNFESIEDATNAALLLCNTGRLMRICAQAHCGAGDELKREFSPEEGLYYNKAIDYYLKALRSLGTRDIHPAVWDSVNWELSTTYFTMATLQQDYAPLSRKAQEQIEKEVSEAMMKSLKYCDVDSVSARQPLCQYRAATIHHRLASMYHSCLRNQVGDEHLRKQHRVLADLHYSKAAKLFQLLKDAPCELLRVQLERVAFAEFQMTSQNSNVGKLKTLSGALDIMVRTEHAFQLIQKELIEEFGQPKSGDAAAAADASPSLNREEVMKLLSIFESRLSFLLLQSIKLLSSTKKKTSNNIEDDTILKTNKHIYSQLLRATANKTATLLERINVIVHLLGQLAAGSAASSNAVQ

SEQ ID NO: 28179 - protein, 1238 aa, Homo sapiens
  Payload ID: 5539
  Gene Symbol: EDRF1
  Gene Name: erythroid differentiation regulatory factor 1
  Uniprot ID: Q3B7T1
  ENSP ID: ENSP00000349244
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGSEPLEPSYIVGHVASAPKEQNLITLFNDGEHSQGLKNDFVRNILWTFEDIHMLVGSNMPIFGGGRYPAVSLRLRDNNKPINVLTGIDYWLDNLICNVPELVMCFHVNGIVQKYEMIKTEEIPNLENSNFSTKVIKDIAQNILSFLKSNCTKEGHTYWLFKASGSDIVKLYDLTTLCEETEDKYQNPFTMPVAILLYKVACNMMMKKNQNKKHYGTIRTLLLNCLKLLDKSRHPQIIASANYMLSELFQLDEPKKEENSESPLNENSDESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGFAWATDLSTDLESQLSVSCKCYEAANEILQFSDLKSQNPEHYVQVLKRMGNIRNEIGVFYMNQAAALQSERLVSKSVSAAEQQLWKKSFSCFEKGIHNFESIEDATNAALLLCNTGRLMRICAQAHCGAGDELKREFSPEEGLYYNKAIDYYLKALRSLGTRDIHPAVWDSVNWELSTTYFTMATLQQDYAPLSRKAQEQIEKEVSEAMMKSLKYCDVDSVSARQPLCQYRAATIHHRLASMYHSCLRNQVGDEHLRKQHRVLADLHYSKAAKLFQLLKDAPCELLRVQLERVAFAEFQMTSQNSNVGKLKTLSGALDIMVRTEHAFQLIQKELIEEFGQPKSGDAAAAADASPSLNREEVMKLLSIFESRLSFLLLQSIKLLSSTKKKTSNNIEDDTILKTNKHIYSQLLRATANKTATLLERINVIVHLLGQLAAGSAASSNAVQ

SEQ ID NO: 28180 - protein, 317 aa, Homo sapiens
  Payload ID: 5539
  Gene Symbol: EDRF1
  Gene Name: erythroid differentiation regulatory factor 1
  ENSP ID: ENSP00000357803
SIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGVPQAWTTWFTVGLCSLAHAYLSIQKRGRNIRVLIFALYLFIYFLRRSFALVAQAGVQWCNLGSLKPPPPGFKQFSCLSLPSSWNYRHAPPCPASPPWPPKVLGLQV

SEQ ID NO: 28181 - protein, 593 aa, Homo sapiens
  Payload ID: 5539
  Gene Symbol: EDRF1
  Gene Name: erythroid differentiation regulatory factor 1
  Uniprot ID: Q3B7T1
  ENSP ID: ENSP00000357805
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGSEPLEPSYIVGHVASAPKEQNLITLFNDGEHSQGLKNDFVRNILWTFEDIHMLVGSNMPIFGGGRYPAVSLRLRDNNKPINVLTGIDYWLDNLICNVPELVMCFHVNGIVQKYEMIKTEEIPNLENSNFSTKVIKDIAQNILSFLKSNCTKEGHTYWLFKASGSDIVKLYDLTTLCEETEDKYQNPFTMPVAILLYKVACNMMMKKNQNKKHYGTIRTLLLNCLKLLDKSRHPQIIASANYMLSELFQLDEPKKEENSESPLNENSDESYSEEEEEMPDSDENGSYSTSSDPSDDSKAVAIIKSVGELSVPEKYKSIHQIRLCISSLP

SEQ ID NO: 28182 - protein, 796 aa, Homo sapiens
  Payload ID: 5539
  Gene Symbol: EDRF1
  Gene Name: erythroid differentiation regulatory factor 1
  Uniprot ID: Q3B7T1
  ENSP ID: ENSP00000396544
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGSEPLEPSYIVGHVASAPKEQNLITLFNDGEHSQGLKNDFVRNILWTFEDIHMLVGSNMPIFGGGRYPAVSLRLRDNNKPINVLTGIDYWLDNLICNVPELVMCFHVNGIVQKYEMIKTEEIPNLENSNFSTKVIKDIAQNILSFLKSNCTKEGHTYWLFKASGSDIVKLYDLTTLCEETEDKYQNPFTMPVAILLYKVACNMMMKKNQNKKHYGTIRTLLLNCLKLLDKSRHPQIIASANYMLSELFQLDEPKKEENSESPLNENSDESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGFKTGK

SEQ ID NO: 28183 - protein, 343 aa, Homo sapiens
  Payload ID: 5539
  Gene Symbol: EDRF1
  Gene Name: erythroid differentiation regulatory factor 1
  ENSP ID: ENSP00000431902
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGSEPLEPSYIVGHVASAPKEQNLITLFNDGEHSQGLKNDFVRNILWTFEDIHMLVGSNMPIFGGGRYPAVSLRLRNVYF

SEQ ID NO: 28184 - protein, 23 aa, Homo sapiens
  Payload ID: 5539
  Gene Symbol: EDRF1
  Gene Name: erythroid differentiation regulatory factor 1
  ENSP ID: ENSP00000432102
  MOD_RES (1)..(1): Any amino acid
XSRLSFLLLQSIKLLSSTKKKTR

SEQ ID NO: 28185 - protein, 151 aa, Homo sapiens
  Payload ID: 5539
  Gene Symbol: EDRF1
  Gene Name: erythroid differentiation regulatory factor 1
  ENSP ID: ENSP00000432229
  MOD_RES (1)..(1): Any amino acid
XEGASWPAPFEMPSSVSEDPSASSQGSEPLEPSYIVGHVASAPKEQNLITLFNDGEHSQGLKNDFVRNILWTFEDIHMLVGSNMPIFGGGRYPAVSLRLRDNNKPINVLTGIDYWLDNLICNVPELVMCFHVNGIVQLPHMLLFLFDGKRD

SEQ ID NO: 28186 - protein, 193 aa, Homo sapiens
  Payload ID: 5540
  Gene Symbol: EPO
  Gene Name: erythropoietin
  Uniprot ID: P01588
  ENSP ID: ENSP00000252723
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 28187 - protein, 508 aa, Homo sapiens
  Payload ID: 5541
  Gene Symbol: EPOR
  Gene Name: erythropoietin receptor
  Uniprot ID: P19235
  ENSP ID: ENSP00000222139
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 28188 - protein, 119 aa, Homo sapiens
  Payload ID: 5541
  Gene Symbol: EPOR
  Gene Name: erythropoietin receptor
  ENSP ID: ENSP00000466784
MDHLGASLWPQVGSLCLLLAGAAWAPPPNLPDPKFESKAALLAARGPEELLCFTERLEDLVCFWEEAASAGVGPGNYSFSYQLEAGTPSMGRGANTPAITAGTRPQTSGWDNNASKSRG

SEQ ID NO: 28189 - protein, 130 aa, Homo sapiens
  Payload ID: 5541
  Gene Symbol: EPOR
  Gene Name: erythropoietin receptor
  ENSP ID: ENSP00000467230
MDHLGASLWPQVGSLCLLLAGAAWAPPPNLPDPKFESKAALLAARGPEELLCFTERLEDLVCFWEEAASAGVGPGNYSFSYQLDRGHWRETCGSRAGTPSMGRGANTPAITAGTRPQTSGWDNNASKSRG

SEQ ID NO: 28190 - protein, 328 aa, Homo sapiens
  Payload ID: 5541
  Gene Symbol: EPOR
  Gene Name: erythropoietin receptor
  Uniprot ID: P19235
  ENSP ID: ENSP00000467809
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQVGGLVVPSVPGLPCFLQPNCRPL

SEQ ID NO: 28191 - protein, 276 aa, Homo sapiens
  Payload ID: 5541
  Gene Symbol: EPOR
  Gene Name: erythropoietin receptor
  ENSP ID: ENSP00000468187
MDHLGASLWPQVGSLCLLLAGAAWAPPPNLPDPKFESKGWGGAGSPELEVLNAAPSSAGRWVGRCAPVVTAGDTALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRGTVFLSPDWLSSTRARPHVIYFCLLRVPRPDSAPRWRSWRAAPSVC

SEQ ID NO: 28192 - protein, 233 aa, Homo sapiens
  Payload ID: 5542
  Gene Symbol: ERAS
  Gene Name: ES cell expressed Ras
  Uniprot ID: Q7Z444
  ENSP ID: ENSP00000339136
MELPTKPGTFDLGLATWSPSFQGETHRAQARRRDVGRQLPEYKAVVVGASGVGKSALTIQLNHQCFVEDHDPTIQDSYWKELTLDSGDCILNVLDTAGQAIHRALRDQCLAVCDGVLGVFALDDPSSLIQLQQIWATWGPHPAQPLVLVGNKCDLVTTAGDAHAAAAALAHSWGAHFVETSAKTRQGVEEAFSLLVHEIQRVQEAMAKEPMARSCREKTRHQKATCHCGCSVA

SEQ ID NO: 28193 - protein, 851 aa, Homo sapiens
  Payload ID: 5543
  Gene Symbol: ESF1
  Gene Name: ESF1 nucleolar pre-rRNA processing protein homolog
  Uniprot ID: Q9H501
  ENSP ID: ENSP00000202816
MSSKQEIMSDQRFRRVAKDPRFWEMPEKDRKVKIDKRFRAMFHDKKFKLNYAVDKRGRPISHSTTEDLKRFYDLSDSDSNLSGEDSKALSQKKIKKKKTQTKKEIDSKNLVEKKKETKKANHKGSENKTDLDNSIGIKKMKTSCKFKIDSNISPKKDSKEFTQKNKKEKKNIVQHTTDSSLEEKQRTLDSGTSEIVKSPRIECSKTRREMQSVVQLIMTRDSDGYENSTDGEMCDKDALEEDSESVSEIGSDEESENEITSVGRASGDDDGSEDDEEEDEDEEEDEDEDSEDDDKSDSGPDLARGKGNIETSSEDEDDTADLFPEESGFEHAWRELDKDAPRADEITRRLAVCNMDWDRLKAKDLLALFNSFKPKGGVIFSVKIYPSEFGKERMKEEQVQGPVELLSIPEDAPEKDWTSREKLRDYQFKRLKYYYAVVDCDSPETASKIYEDCDGLEFESSCSFIDLRFIPDDITFDDEPKDVASEVNLTAYKPKYFTSAAMGTSTVEITWDETDHERITMLNRKFKKEELLDMDFQAYLASSSEDEEEIEEELQGDDGVNVEEDGKTKKSQKDDEEQIAKYRQLLQVIQEKEKKGKENDMEMEIKWVPGLKESAEEMVKNKLEGKDKLTPWEQFLEKKKEKKRLKRKQKALAEEASEEELPSDVDLNDPYFAEEVKQIGINKKSVKSAKDGTSPEEEIEIERQKAEMALLMMDEDEDSKKHFNYNKIVEHQNLSKKKKKQLMKKKELIEDDFEVNVNDARFQAMYTSHLFNLDPSDPNFKKTKAMEKILEEKARQRERKEQELTQAIKKKESEIEKESQRKSIDPALSMLIKSIKTKTEQFQARKKQKVK

SEQ ID NO: 28194 - protein, 456 aa, Homo sapiens
  Payload ID: 5543
  Gene Symbol: ESF1
  Gene Name: ESF1 nucleolar pre-rRNA processing protein homolog
  ENSP ID: ENSP00000480783
MQSVVQLIMTRDSDGYENSTDGEMCDKDALEEDSESVSEIGSDEESENEITSVGRASGDDDGSEDDEEEDEDEEEDEDEDSEDDDKSDSGPDLARGKGNIETSSEDEDDTADLFPEESGFEHAWRELDKDAPRADEITRRLAVCNMDWDRLKAKDLLALFNSFKPKGGVIFSVKIYPSEFGKERMKEEQVQGPVELLSIPEDAPEKDWTSREKLRDYQFKRLKYYYAVVDCDSPETASKIYEDCDGLEFESSCSFIDLRFIPDDITFDDEPKDVASEVNLTAYKPKYFTSAAMGTSTVEITWDETDHERITMLNRKFKKEELLDMDFQAYLASSSEDEEEIEEELQGDDGVNVEEDGKTKKSQKDDEEQIAKYRQLLQVIQEKEKKGKENDMEMEIKWVPGLKESAEEMVKNKLEGKDKLTPWEQFLEKKKEKKRLKRKQKALAEEASEEELPSLI

SEQ ID NO: 28195 - protein, 854 aa, Homo sapiens
  Payload ID: 5544
  Gene Symbol: ESPN
  Gene Name: espin
  Uniprot ID: B1AK53
  ENSP ID: ENSP00000367059
MALEQALQAARQGELDVLRSLHAAGLLGPSLRDPLDALPVHHAARAGKLHCLRFLVEEAALPAAARARNGATPAHDASATGHLACLQWLLSQGGCRVQDKDNSGATVLHLAARFGHPEVVNWLLHHGGGDPTAATDMGALPIHYAAAKGDFPSLRLLVEHYPEGVNAQTKNGATPLYLACQEGHLEVTQYLVQECGADPHARAHDGMTPLHAAAQMGHSPVIVWLVSCTDVSLSEQDKDGATAMHFAASRGHTKVLSWLLLHGGEISADLWGGTPLHDAAENGELECCQILVVNGAELDVRDRDGYTAADLSDFNGHSHCTRYLRTVENLSVEHRVLSRDPSAELEAKQPDSGMSSPNTTVSVQPLNFDLSSPTSTLSNYDSCSSSHSSIKGQHPPCGLSSARAADIQSYMDMLNPELGLPRGTIGKPTPPPPPPSFPPPPPPPGTQLPPPPPGYPAPKPPVGPQAADIYMQTKNKLRHVETEALKKELSSCDGHDGLRRQDSSRKPRAFSKQPSTGDYYRQLGRCPGETLAARPGMAHSEEVRARQPARAGCPRLGPAARGSLEGPSAPPQAALLPGNHVPNGCAADPKASRELPPPPPPPPPPLPEAASSPPPAPPLPLESAGPGCGQRRSSSSTGSTKSFNMMSPTGDNSELLAEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKEEEEEARLASMPAWRRDLLRKKLEEEREQKRKEEERQKQEELRREKEQSEKLRTLGYDESKLAPWQRQVILKKGDIAKY

SEQ ID NO: 28196 - protein, 288 aa, Homo sapiens [sequence omitted]

SEQ ID NO: 28197 - protein, 213 aa, Homo sapiens
  Payload ID: 5544
  Gene Symbol: ESPN
  Gene Name: espin
  ENSP ID: ENSP00000401793
DGMTPLHAAAQMGHSPVIVWLDKDGATAMHFAASRGHTKVLSWLLLHGGEISADLWGGTPLHDAAENGELECCQILVVNGAELDVRDRDGYTAADLSDFNGHSHCTRYLRTVENLSVEHRVLSRDPSAELEAKQPDSGMSSPNTTVSVQPLNFDLSSPTSTLSNYDSCSSSHSSIKGQHPPCGLSSARAADIQSYMDMLNPELGLPRGTIGKP

SEQ ID NO: 28198 - protein, 188 aa, Homo sapiens
  Payload ID: 5544
  Gene Symbol: ESPN
  Gene Name: espin
  ENSP ID: ENSP00000413621
  MOD_RES (1)..(1): Any amino acid
XEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKEEEEEARLASMPAWRRDLLRKKLEEEREQKRKEEERQKQEELRREKEQSEKLRTLGYDESKLAPWQRQI

SEQ ID NO: 28199 - protein, 288 aa, Homo sapiens
  Payload ID: 5544
  Gene Symbol: ESPN
  Gene Name: espin
  Uniprot ID: B1AK53
  ENSP ID: ENSP00000465308
MAHSEEAALLPGNHVPNGCAADPKASRELPPPPPPPPPPLPEAASSPPPAPPLPLESAGPGCGQRRSSSSTGSTKSFNMMSPTGDNSELLAEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKEEEEEARLASMPAWRRDLLRKKLEEEREQKRKEEERQKQEELRREKEQSEKLRTLGYDESKLAPWQRQVILKKGDIAKY

SEQ ID NO: 28200 - protein, 28 aa, Homo sapiens
  Payload ID: 5544
  Gene Symbol: ESPN
  Gene Name: espin
  ENSP ID: ENSP00000466437
MAHSEEAALLPGNHVPNGCAADPKASRE

SEQ ID NO: 28201 - protein, 60 aa, Homo sapiens
  Payload ID: 5544
  Gene Symbol: ESPN
  Gene Name: espin
  ENSP ID: ENSP00000487748
MAHSEEAALLPGNHVPNGCAADPKASRELPPPPPPPPPPLPEAASSPPPAPPLPLESAGP

SEQ ID NO: 28202 - protein, 237 aa, Homo sapiens
  Payload ID: 5544
  Gene Symbol: ESPN
  Gene Name: espin
  ENSP ID: ENSP00000488071
GCGQRRSSSSTGKVRVLRHRKSTKSFNMMSPTGDNSELLAEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKEEEEEARLASMPAWRRDLLRKKLEEEREQKRKEEERQKQEELRREKEQSEKLRTLGYDESKLAPWQRQVILKKGDIAKY

SEQ ID NO: 28203 - protein, 178 aa, Homo sapiens
  Payload ID: 5544
  Gene Symbol: ESPN
  Gene Name: espin
  ENSP ID: ENSP00000488721
MSPTGDNSELLAEIKAGKSLKPTPQSKGLTTVFSGIGQPAFQPDSPLPSVSPALSPVRSPTPPAAGFQPLLNGSLVPVPPTTPAPGVQLDVEALIPTHDEQGRPIPEWKRQVMVRKMQLKMQEEEEQRRKEEEEEARLASMPAWRRDLLRKKLEEEREQKRKEEERQKQEELRREKEQ

SEQ ID NO: 28204 - protein, 1005 aa, Homo sapiens
  Payload ID: 5545
  Gene Symbol: ESPNL
  Gene Name: espin-like
  Uniprot ID: Q6ZVH7
  ENSP ID: ENSP00000339115
MEKQRALVAAKDGDVATLERLLEAGALGPGITDALGAGLVHHATRAGHLDCVKFLVQRAQLPGNQRAHNGATPAHDAAATGSLAELCWLVREGGCGLQDQDASGVSPLHLAARFGHPVLVEWLLHEGHSATLETREGARPLHHAAVSGDLTCLKLLTAAHGSSVNRRTRSGASPLYLACQEGHLHLAQFLVKDCGADVHLRALDGMSALHAAAARGHYSLVVWLVTFTDIGLTARDNEGATALHFAARGGHTPILDRLLLMGTPILRDSWGGTPLHDAAENGQMECCQTLVSHHVDPSLRDEDGYTAADLAEYHGHRDCAQYLREVAQPVPLLMTPPPPPFPPPPLLATRRSLEDGRRGGPGPGNPSPMSLSPAWPGHPDQPLPREQMTSPAPPRIITSATADPEGTETALAGDTSDGLAALQLDGLPSGDIDGLVPTRDERGQPIPEWKRQVMVRKLQARLGAESSAEAQDNGGSSGPTEQAAWRYSQTHQAILGPFGELLTEDDLVYLEKQIADLQLRRRCQEYESELGRLAAELQALLPEPLVSITVNSHFLPRAPGLEVEEASIPAAEPAGSAEASEVAPGVQPLPFWCSHISRLVRSLSLLLKGVHGLVQGDEKPSTRPLQDTCREASASPPRSEAQRQIQEWGVSVRTLRGNFESASGPLCGFNPGPCEPGAQHRQCLSGCWPALPKPRSGLASGEPRPGDTEEASDSGISCEEVPSEAGAAAGPDLASLRKERIIMLFLSHWRRSAYTPALKTVACRTLGARHAGLRGQEAARSPGPPSPPSEGPRLGHLWQQRSTITHLLGNWKAIMAHVPARQLRRLSRQPRGALSPEQFLPHVDGAPVPYSSLSLDLFMLGYFQLLECDLPAEERKLRHLLCFEVFEHLGTHGWEAVRAFHKAVTDEVAAGRRAWTDGFEDIKARFFGSSQRPAWDTEPGRKSGLTLLGPLPHAAVPCSGPEPTAQRLGSRSQQGSFNGEDICGYINRSFAFWKEKEAEMFNFGE

SEQ ID NO: 28205 - protein, 961 aa, Homo sapiens
  Payload ID: 5545
  Gene Symbol: ESPNL
  Gene Name: espin-like
  Uniprot ID: Q6ZVH7
  ENSP ID: ENSP00000386577
MEKQRALVAAKDGDVATLERLLEAGALGPGITDALGAGLVHHATRAGHLDCVKFLVQRAQLPGNQRAHNGATPAHDAAATGSLAELCWLVREGGCGLQDQDASGVSPLHLAARFGHPVLVEWLLHEGHSATLETREGARPLHHAAVSGDLTCLKLLTAAHGSSVNRRTRSGASPLYLACQEGHLHLAQFLVKDCGADVHLRALDGMSALHAAAARGHYSLVVWLVTFTDIGLTARDNEGATALHFAARGGHTPILDRLLLMGTPILRDSWGGTPLHDAAENGQMEVPLLMTPPPPPFPPPPLLATRRSLEDGRRGGPGPGNPSPMSLSPAWPGHPDQPLPREQMTSPAPPRIITSATADPEGTETALAGDTSDGLAALQLDGLPSGDIDGLVPTRDERGQPIPEWKRQVMVRKLQARLGAESSAEAQDNGGSSGPTEQAAWRYSQTHQAILGPFGELLTEDDLVYLEKQIADLQLRRRCQEYESELGRLAAELQALLPEPLVSITVNSHFLPRAPGLEVEEASIPAAEPAGSAEASEVAPGVQPLPFWCSHISRLVRSLSLLLKGVHGLVQGDEKPSTRPLQDTCREASASPPRSEAQRQIQEWGVSVRTLRGNFESASGPLCGFNPGPCEPGAQHRQCLSGCWPALPKPRSGLASGEPRPGDTEEASDSGISCEEVPSEAGAAAGPDLASLRKERIIMLFLSHWRRSAYTPALKTVACRTLGARHAGLRGQEAARSPGPPSPPSEGPRLGHLWQQRSTITHLLGNWKAIMAHVPARQLRRLSRQPRGALSPEQFLPHVDGAPVPYSSLSLDLFMLGYFQLLECDLPAEERKLRHLLCFEVFEHLGTHGWEAVRAFHKAVTDEVAAGRRAWTDGFEDIKARFFGSSQRPAWDTEPGRKSGLTLLGPLPHAAVPCSGPEPTAQRLGSRSQQGSFNGEDICGYINRSFAFWKEKEAEMFNFGE

SEQ ID NO: 28206 - protein, 637 aa, Homo sapiens
  Payload ID: 5545
  Gene Symbol: ESPNL
  Gene Name: espin-like
  Uniprot ID: Q6ZVH7
  ENSP ID: ENSP00000386579
MSLSPAWPGHPDQPLPREQMTSPAPPRIITSATADPEGTETALAGDTSDGLAALQLDGLPSGDIDGLVPTRDERGQPIPEWKRQVMVRKLQARLGAESSAEAQDNGGSSGPTEQAAWRYSQTHQAILGPFGELLTEDDLVYLEKQIADLQLRRRCQEYESELGRLAAELQALLPEPLVSITVNSHFLPRAPGLEVEEASIPAAEPAGSAEASEVAPGVQPLPFWCSHISRLVRSLSLLLKGVHGLVQGDEKPSTRPLQDTCREASASPPRSEAQRQIQEWGVSVRTLRGNFESASGPLCGFNPGPCEPGAQHRQCLSGCWPALPKPRSGLASGEPRPGDTEEASDSGISCEEVPSEAGAAAGPDLASLRKERIIMLFLSHWRRSAYTPALKTVACRTLGARHAGLRGQEAARSPGPPSPPSEGPRLGHLWQQRSTITHLLGNWKAIMAHVPARQLRRLSRQPRGALSPEQFLPHVDGAPVPYSSLSLDLFMLGYFQLLECDLPAEERKLRHLLCFEVFEHLGTHGWEAVRAFHKAVTDEVAAGRRAWTDGFEDIKARFFGSSQRPAWDTEPGRKSGLTLLGPLPHAAVPCSGPEPTAQRLGSRSQQGSFNGEDICGYINRSFAFWKEKEAEMFNFGE

SEQ ID NO: 28207 - protein, 82 aa, Homo sapiens
  Payload ID: 5545
  Gene Symbol: ESPNL
  Gene Name: espin-like
  ENSP ID: ENSP00000417001
MSLSPAWPGHPDQPLPREQMTSPAPPRIITSATADPEGTETALAGDTSDGLAALQLDGLPSGDIDGLVPTRDERGQPIPEWK

SEQ ID NO: 28208 - protein, 140 aa, Homo sapiens
  Payload ID: 5545
  Gene Symbol: ESPNL
  Gene Name: espin-like
  ENSP ID: ENSP00000479394
MGHPSPGHLCPAGPRDLGCCLFLTCPSPVSPVPLASCPSVSVVLVASATSIFHVSLRWPQALVLPLFLLLTLGHTPSPPICEFGGAGVIPRTDSMGRRPSCQAIPAGHTPMPARPVPQPRVLRRPCFLKGGSPWGPCPPA

SEQ ID NO: 28209 - protein, 570 aa, Homo sapiens
  Payload ID: 5546
  Gene Symbol: EME1
  Gene Name: essential meiotic structure-specific endonuclease 1
  Uniprot ID: Q96AY2
  ENSP ID: ENSP00000339897
MALKKSSPSLDSGDSDSEELPTFAFLKKEPSSTKRRQPEREEKIVVVDISDCEASCPPAPELFSPPVPEIAETVTQTQPVRLLSSESEDEEEFIPLAQRLTCKFLTHKQLSPEDSSSPVKSVLDHQNNEGASCDWKKPFPKIPEVPLHDTPERSAADNKDLILDPCCQLPAYLSTCPGQSSSLAVTKTNSDILPPQKKTKPSQKVQGRGSHGCRQQRQARQKESTLRRQERKNAALVTRMKAQRPEECLKHIIVVLDPVLLQMEGGGQLLGALQTMECRCVIEAQAVPCSVTWRRRAGPSEDREDWVEEPTVLVLLRAEAFVSMIDNGKQGSLDSTMKGKETLQGFVTDITAKTAGKALSLVIVDQEKCFSAQNPPRRGKQGANKQTKKQQQRQPEASIGSMVSRVDAEEALVDLQLHTEAQAQIVQSWKELADFTCAFTKAVAEAPFKKLRDETTFSFCLESDWAGGVKVDLAGRGLALVWRRQIQQLNRVSLEMASAVVNAYPSPQLLVQAYQQCFSDKERQNLLADIQVRRGEGVTSTSRRIGPELSRRIYLQMTTLQPHLSLDSAD

SEQ ID NO: 28210 - protein, 583 aa, Homo sapiens
  Payload ID: 5546
  Gene Symbol: EME1
  Gene Name: essential meiotic structure-specific endonuclease 1
  Uniprot ID: Q96AY2
  ENSP ID: ENSP00000376952
MALKKSSPSLDSGDSDSEELPTFAFLKKEPSSTKRRQPEREEKIVVVDISDCEASCPPAPELFSPPVPEIAETVTQTQPVRLLSSESEDEEEFIPLAQRLTCKFLTHKQLSPEDSSSPVKSVLDHQNNEGASCDWKKPFPKIPEVPLHDTPERSAADNKDLILDPCCQLPAYLSTCPGQSSSLAVTKTNSDILPPQKKTKPSQKVQGRGSHGCRQQRQARQKESTLRRQERKNAALVTRMKAQRPEECLKHIIVVLDPVLLQMEGGGQLLGALQTMECRCVIEAQAVPCSVTWRRRAGPSEDREDWVEEPTVLVLLRAEAFVSMIDNGKQGSLDSTMKGKETLQGFVTDITAKTAGKALSLVIVDQEKCFSLELLFFDFLPCTSAQNPPRRGKQGANKQTKKQQQRQPEASIGSMVSRVDAEEALVDLQLHTEAQAQIVQSWKELADFTCAFTKAVAEAPFKKLRDETTFSFCLESDWAGGVKVDLAGRGLALVWRRQIQQLNRVSLEMASAVVNAYPSPQLLVQAYQQCFSDKERQNLLADIQVRRGEGVTSTSRRIGPELSRRIYLQMTTLQPHLSLDSAD

SEQ ID NO: 28211 - protein, 583 aa, Homo sapiens; identical to SEQ ID NO: 28210
  Payload ID: 5546
  Gene Symbol: EME1
  Gene Name: essential meiotic structure-specific endonuclease 1
  Uniprot ID: Q96AY2
  ENSP ID: ENSP00000421700

SEQ ID NO: 28212 - protein, 171 aa, Homo sapiens
  Payload ID: 5546
  Gene Symbol: EME1
  Gene Name: essential meiotic structure-specific endonuclease 1
  ENSP ID: ENSP00000423029
MALKKSSPSLDSGDSDSEELPTFAFLKKEPSSTKRRQPEREEKIVVVDISDCEASCPPAPELFSPPVPEIAETVTQTQPVRLLSSESEDEEEFIPLAQRLTLLLQMEGGGQLLGALQTMECRCVIEAQAVPCSVTWRRRAGPSERGLGGGANSTGVAPGRGICVHDRQWKA

SEQ ID NO: 28213 - protein, 337 aa, Homo sapiens
  Payload ID: 5546
  Gene Symbol: EME1
  Gene Name: essential meiotic structure-specific endonuclease 1
  ENSP ID: ENSP00000425567
  MOD_RES (1)..(1): Any amino acid
XLILDPCCQLPAYLSTCPGQSSSLAVTKTNSDILPPQKKTKPSQKVQGRGSHGCRQQRQARQKESTLRRQERKNAALVTRMKAQRPEECLKHIIVVLDPVLLQMEGGGQLLGALQTMECRCVIEAQAVPCSVTWRRRAGPSEGSLDSTMKGKETLQGFVTDITAKTAGKALSLVIVDQEKCFSAQNPPRRGKQGANKQTKKQQQRQPEASIGSMVSRVDAEEALVDLQLHTEAQAQIVQSWKELADFTCAFTKAVAEAPFKKLRDETTFSFCLESDWAGGVKVDLAGRGLALVWRRQIQQLNRVSLEMASAVVNAYPSPQLLVQAYQQCFSDKERQN

SEQ ID NO: 28214 - protein, 101 aa, Homo sapiens
  Payload ID: 5546
  Gene Symbol: EME1
  Gene Name: essential meiotic structure-specific endonuclease 1
  ENSP ID: ENSP00000427392
MALKKSSPSLDSGDSDSEELPTFAFLKKEPSSTKRRQPEREEKIVVVDISDCEASCPPAPELFSPPVPEIAETVTQTQPVRLLSSESEDEEEFIPLAQRLT

SEQ ID NO: 28215 - protein, 115 aa, Homo sapiens
  Payload ID: 5547
  Gene Symbol: EME2
  Gene Name: essential meiotic structure-specific endonuclease subunit 2
  ENSP ID: ENSP00000456946
  MOD_RES (1)..(1): Any amino acid
XQAFSFCTAGRWAAGEPVARDGAGLQAAWRRQIRQFSRVSPAVADAVVTAFPSPRLLQQALEACSTERERMGLLADLPVPPSEGGRPRRVGPDLSRRICLFLTTANPDLLLDLGS

SEQ ID NO: 28216 - protein, 379 aa, Homo sapiens
  Payload ID: 5547
  Gene Symbol: EME2
  Gene Name: essential meiotic structure-specific endonuclease subunit 2
  Uniprot ID: A4GXA9
  ENSP ID: ENSP00000457353
MARVGPGRAGVSCQGRGRGRGGSGQRRPPTWEISDSDAEDSAGSEAAARARDPAGERRAAAEALRLLRPEQVLKRLAVCVDTAILEDAGADVLMEALEALGCECRIEPQRPARSLRWTRASPDPCPRSLPPEVWAAGEQELLLLLEPEEFLQGVATLTQISGPTHWVPWISPETTARPHLAVIGLDAYLWSRQHVSRGTQQPESPKVAGAEVAVSWPEVEEALVLLQLWANLDVLLVASWQELSRHVCAVTKALAQYPLKQYRESQAFSFCTAGRWAAGEPVARDGAGLQAAWRRQIRQFSRVSPAVADAVVTAFPSPRLLQQALEACSTERERMGLLADLPVPPSEGGRPRRVGPDLSRRICLFLTTANPDLLLDLGS

SEQ ID NO: 28217 - protein, 190 aa, Homo sapiens
  Payload ID: 5547
  Gene Symbol: EME2
  Gene Name: essential meiotic structure-specific endonuclease subunit 2
  ENSP ID: ENSP00000457966
  MOD_RES (1)..(1): Any amino acid
XSRQHVSRGTQQPESPKVAGAEVAVSWPEVEEALVLLQLWANLDVLLVASWQELSRHVCAVTKALAQYPLKQYRESQAFSFCTAGRWAAGEPVARDGAGLQAAWRRQIRQFSRVSPAVADAVVTAFPSPRLLQQALEACSTERERMGLLADLPVPPSEGGRPRRVGPDLSRRICLFLTTANPDLLLDLGS

SEQ ID NO: 28218 - protein, 840 aa, Homo sapiens
  Payload ID: 5548
  Gene Symbol: ESCO1
  Gene Name: establishment of sister chromatid cohesion N-acetyltransferase 1
  Uniprot ID: Q5FWF5
  ENSP ID: ENSP00000269214
MMSIQEKSKENSSKVTKKSDDKNSETEIQDSQKNLAKKSGPKETIKSQAKSSSESKINQPELETRMSTRSSKAASNDKATKSINKNTVTVRGYSQESTKKKLSQKKLVHENPKANEQLNRRSQRLQQLTEVSRRSLRSREIQGQVQAVKQSLPPTKKEQCSSTQSKSNKTSQKHVKRKVLEVKSDSKEDENLVINEVINSPKGKKRKVEHQTACACSSQCTQGSEKCPQKTTRRDETKPVPVTSEVKRSKMATSVVPKKNEMKKSVHTQVNTNTTLPKSPQPSVPEQSDNELEQAGKSKRGSILQLCEEIAGEIESDNVEVKKESSQMESVKEEKPTEIKLEETSVERQILHQKETNQDVQCNRFFPSRKTKPVKCILNGINSSAKKNSNWTKIKLSKFNSVQHNKLDSQVSPKLGLLRTSFSPPALEMHHPVTQSTFLGTKLHDRNITCQQEKMKEINSEEVKINDITVEINKTTERAPENCHLANEIKPSDPPLDNQMKHSFDSASNKNFSQCLESKLENSPVENVTAASTLLSQAKIDTGENKFPGSAPQQHSILSNQTSKSSDNRETPRNHSLPKCNSHLEITIPKDLKLKEAEKTDEKQLIIDAGQKRFGAVSCNVCGMLYTASNPEDETQHLLFHNQFISAVKYVGWKKERILAEYPDGRIIMVLPEDPKYALKKVDEIREMVDNDLGFQQAPLMCYSRTKTLLFISNDKKVVGCLIAEHIQWGYRVIEEKLPVIRSEEEKVRFERQKAWCCSTLPEPAICGISRIWVFSMMRRKKIASRMIECLRSNFIYGSYLSKEEIAFSDPTPDGKLFATQYCGTGQFLVYNFINGQNST

SEQ ID NO: 28219 - protein, 701 aa, Homo sapiens
  Payload ID: 5548
  Gene Symbol: ESCO1
  Gene Name: establishment of sister chromatid cohesion N-acetyltransferase 1
  Uniprot ID: Q5FWF5
  ENSP ID: ENSP00000372763
MMSIQEKSKENSSKVTKKSDDKNSETEIQDSQKNLAKKSGPKETIKSQAKSSSESKINQPELETRMSTRSSKAASNDKATKSINKNTVTVRGYSQESTKKKLSQKKLVHENPKANEQLNRRSQRLQQLTEVSRRSLRSREIQGQVQAVKQSLPPTKKEQCSSTQSKSNKTSQKHVKRKVLEVKSDSKEDENLVINEVINSPKGKKRKVEHQTACACSSQCTQGSEKCPQKTTRRDETKPVPVTSEVKRSKMATSVVPKKNEMKKSVHTQVNTNTTLPKSPQPSVPEQSDNELEQAGKSKRGSILQLCEEIAGEIESDNVEVKKESSQMESVKEEKPTEIKLEETSVERQILHQKETNQDVQCNRFFPSRKTKPVKCILNGINSSAKKNSNWTKIKLSKFNSVQHNKLDSQVSPKLGLLRTSFSPPALEMHHPVTQSTFLGTKLHDRNITCQQEKMKEINSEEVKINDITVEINKTTERAPENCHLANEIKPSDPPLDNQMKHSFDSASNKNFSQCLESKLENSPVENVTAASTLLSQAKIDTGENKFPGSAPQQHSILSNQTSKSSDNRETPRNHSLPKCNSHLEITIPKDLKLKEAEKTDEKQLIIDAGQKRFGAVSCNVCGMLYTASNPEDETQHLLFHNQFISAVKYVVLLINHHECGSEEEFITSLFLSMFNFRYTQRSFSFPIRFLEGLEERKNSG

SEQ ID NO: 28220 - protein, 172 aa, Homo sapiens
  Payload ID: 5548
  Gene Symbol: ESCO1
  Gene Name: establishment of sister chromatid cohesion N-acetyltransferase 1
  ENSP ID: ENSP00000484873
MVLPEDPKYALKKVDEIREMVDNDLGFQQAPLMCYSRTKTLLFISNDKKVVGCLIAEHIQWGYRVIEEKLPVIRSEEEKVRFERQKAWCCSTLPEPAICGISRIWVFSMMRRKKIASRMIECLRSNFIYGSYLSKEEIAFSDPTPDGKLFATQYCGTGQFLVYNFINGQNST

SEQ ID NO: 28221 - protein, 601 aa, Homo sapiens
  Payload ID: 5549
  Gene Symbol: ESCO2
  Gene Name: establishment of sister chromatid cohesion N-acetyltransferase 2
  Uniprot ID: Q56NI9
  ENSP ID: ENSP00000306999
MAALTPRKRKQDSLKCDSLLHFTENLFPSPNKKHCFYQNSDKNEENLHCSQQEHFVLSALKTTEINRLPSANQGSPFKSALSTVSFYNQNKWYLNPLERKLIKESRSTCLKTNDEDKSFPIVTEKMQGKPVCSKKNNKKPQKSLTAKYQPKYRHIKPVSRNSRNSKQNRVIYKPIVEKENNCHSAENNSNAPRVLSQKIKPQVTLQGGAAFFVRKKSSLRKSSLENEPSLGRTQKSKSEVIEDSDVETVSEKKTFATRQVPKCLVLEEKLKIGLLSASSKNKEKLIKDSSDDRVSSKEHKVDKNEAFSSEDSLGENKTISPKSTVYPIFSASSVNSKRSLGEEQFSVGSVNFMKQTNIQKNTNTRDTSKKTKDQLIIDAGQKHFGATVCKSCGMIYTASNPEDEMQHVQHHHRFLEGIKYVGWKKERVVAEFWDGKIVLVLPHDPSFAIKKVEDVQELVDNELGFQQVVPKCPNKIKTFLFISDEKRVVGCLIAEPIKQAFRVLSEPIGPESPSSTECPRAWQCSDVPEPAVCGISRIWVFRLKRRKRIARRLVDTLRNCFMFGCFLSTDEIAFSDPTPDGKLFATKYCNTPNFLVYNFNS

SEQ ID NO: 28222 - protein, 239 aa, Homo sapiens
  Payload ID: 5549
  Gene Symbol: ESCO2
  Gene Name: establishment of sister chromatid cohesion N-acetyltransferase 2
  Uniprot ID: Q56NI9
  ENSP ID: ENSP00000380563
MKQTNIQKNTNTRDTSKKTKDQLIIDAGQKHFGATVCKSCGMIYTASNPEDEMQHVQHHHRFLEGIKYVGWKKERVVAEFWDGKIVLVLPHDPSFAIKKVEDVQELVDNELGFQQVVPKCPNKIKTFLFISDEKRVVGCLIAEPIKQAFRVLSEPIGPESPSSTECPRAWQCSDVPEPAVCGISRIWVFRLKRRKRIARRLVDTLRNCFMFGCFLSTDEIAFSDPTPDDCRRLNRYQET

SEQ ID NO: 28223 - protein, 133 aa, Homo sapiens
  Payload ID: 5549
  Gene Symbol: ESCO2
  Gene Name: establishment of sister chromatid cohesion N-acetyltransferase 2
  ENSP ID: ENSP00000428027
MAALTPRKRKQDSLKCDSLLHFTENLFPSPNKKHCFYQNSDKNEENLHCSQQEHFVLSALKTTEINRLPSANQGSPFKSALSTVSFYNQNKWYLNPLERKLIKESRSTCLKTNDEDKSFPIVTEKMQGKPVCS

SEQ ID NO: 28224 - protein, 187 aa, Homo sapiens
  Payload ID: 5549
  Gene Symbol: ESCO2
  Gene Name: establishment of sister chromatid cohesion N-acetyltransferase 2
  ENSP ID: ENSP00000428435
MAALTPRKRKQDSLKCDSLLHFTENLFPSPNKKHCFYQNSDKNEENLHCSQQEHFVLSALKTTEINRLPSANQGSPFKSALSTVSFYNQNKWYLNPLERKLIKESRSTCLKTNDEDKSFPIVTEKMQGKPVCSKKNNKKPQKSLTAKYQPKYRHIKPVSRNSRNSKQNRVIYKPIVEKENNCHSAEN

SEQ ID NO: 28225 - protein, 290 aa, Homo sapiens
  Payload ID: 5549
  Gene Symbol: ESCO2
  Gene Name: establishment of sister chromatid cohesion N-acetyltransferase 2
  ENSP ID: ENSP00000428928
MAALTPRKRKQDSLKCDSLLHFTENLFPSPNKKHCFYQNSDKNEENLHCSQQEHFVLSALKTTEINRLPSANQGSPFKSALSTVSFYNQNKWYLNPLERKLIKESRSTCLKTNDEDKSFPIVTEKMQGKPVCSKKNNKKPQKSLTAKYQPKYRHIKPVSRNSRNSKQNRVIYKPIVEKENNCHSAENNSNAPRVLSQKIKPQVTLQGGAAFFVRKKSSLRKSSLENEPSLGRTQKSKSEVIEDSDVETVSEKKTFATRQVPKCLVLEEKLKIGLLSASSKNKEKLIKIFR

SEQ ID NO: 28226 - protein, 176 aa, Homo sapiens
  Payload ID: 5549
  Gene Symbol: ESCO2
  Gene Name: establishment of sister chromatid cohesion N-acetyltransferase 2
  ENSP ID: ENSP00000428959
  MOD_RES (1)..(1): Any amino acid
XKEHKVDKNEAFSSEDSLGENKTISPKSTVYPIFSASSVNSKRSLGEEQFSVGSVNFMKQTNIQKNTNTRDTSKKTKDQLIIDAGQKHFGATVCKSCGMIYTASNPEDEMQHVQHHHRFLEGIKYVGWKKERVVAEFWDGKIVLVLPHDPSFAIKKAFRVLSEPIGPESPSSTECP

SEQ ID NO: 28227 - protein, 253 aa, Homo sapiens
  Payload ID: 5550
  Gene Symbol: ESD
  Gene Name: esterase D
  ENSP ID: ENSP00000367969
MKFAVYLPPKAETGKCPALYWLSGLTCTEQNFISKSGYHQSASEHGLVVIAPDTSPRGCNIKGEDESWDFGTGAGFYVDATEDPWKTNYRMYSYVTEELPQLINANFPVDPQRMSIFGHSMGGHGALICALKNPGKYKSVSAFAPICNPVLCPWGKKAFSGYLGTDQSKWKAYDATHLVKSYPGSQLDILIDQGKDDQFLLDGQLLPDNFIAACTEKKIPVVFRLQEGYDHSYYFIATFITDHIRHHAKYLNA

SEQ ID NO: 28228 - protein, 282 aa, Homo sapiens
  Payload ID: 5550
  Gene Symbol: ESD
  Gene Name: esterase D
  Uniprot ID: P10768
  ENSP ID: ENSP00000367992
MALKQISSNKCFGGLQKVFEHDSVELNCKMKFAVYLPPKAETGKCPALYWLSGLTCTEQNFISKSGYHQSASEHGLVVIAPDTSPRGCNIKGEDESWDFGTGAGFYVDATEDPWKTNYRMYSYVTEELPQLINANFPVDPQRMSIFGHSMGGHGALICALKNPGKYKSVSAFAPICNPVLCPWGKKAFSGYLGTDQSKWKAYDATHLVKSYPGSQLDILIDQGKDDQFLLDGQLLPDNFIAACTEKKIPVVFRLQEGYDHSYYFIATFITDHIRHHAKYLNA

SEQ ID NO: 28229 - protein, 230 aa, Homo sapiens
  Payload ID: 5550
  Gene Symbol: ESD
  Gene Name: esterase D
  ENSP ID: ENSP00000391350
  MOD_RES (1)..(1): Any amino acid
XLTCTEQNFISKSGYHQSASEHGLVVIAPDTSPRGCNIKGEDESWDFGTGAGFYVDATEDPWKTNYRMYSYVTEELPQLINANFPVDPQRMSIFGHSMGGHGALICALKNPGKYKSVSAFAPICNPVLCPWGKKAFSGYLGTDQSKWKAYDATHLVKSYPGSQLDILIDQGKDDQFLLDGQLLPDNFIAACTEKKIPVVFRLQEHGRVKSGLHSLKRISLRFVVIESTTE

SEQ ID NO: 28230 - protein, 120 aa, Homo sapiens
  Payload ID: 5550
  Gene Symbol: ESD
  Gene Name: esterase D
  ENSP ID: ENSP00000476193
  MOD_RES (1)..(1): Any amino acid
XSIFGHSMGGHGALICALKNPGKYKSVSAFAPICNPVLCPWGKKAFSGYLGTDQSKWKAYDATHLVKSYPGSQLDILIDQGKDDQFLLDGQLLPDNFIAACTEKKIPVVFRLQEASIRKL

SEQ ID NO: 28231 - protein, 595 aa, Homo sapiens [sequence omitted]

SEQ ID NO: 28232 - protein, 595 aa, Homo sapiens [sequence omitted]

SEQ ID NO: 28233 - protein, 334 aa, Homo sapiens
  Payload ID: 5551
  Gene Symbol: ESR1
  Gene Name: estrogen receptor 1
  ENSP ID: ENSP00000384064
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRLHAPTSRGGASVEETDQSHLATAGSTSSHSLQKYYITGEAEGFPATV

SEQ ID NO: 28234 - protein, 84 aa, Homo sapiens
  Payload ID: 5551
  Gene Symbol: ESR1
  Gene Name: estrogen receptor 1
  ENSP ID: ENSP00000385373
MTMTLHTKASGMALLHQIQGNELEPLNRPQLKIPLERPLGEVYLDSSKPAVYNYPEGAAYEFNAAAAANAQVYGQTGLPYGPGS

SEQ ID NO: 28235 - protein, 595 aa, Homo sapiens [sequence omitted]

SEQ ID NO: 28236 - protein, 310 aa, Homo sapiens
  Payload ID: 5551
  Gene Symbol: ESR1
  Gene Name: estrogen receptor 1
  ENSP ID: ENSP00000394721
MAMESAKETRYCAVCNDYASGYHYGVWSCEGCKAFFKRSIQGHNDYMCPATNQCTIDKNRRKSCQACRLRKCYEVGMMKGGIRKDRRGGRMLKHKRQRDDGEGRGEVGSAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGISHVEAKKRILNLHPKIFGNKWFPRV

SEQ ID NO: 28237 - protein, 107 aa, Homo sapiens
  Payload ID: 5551
  Gene Symbol: ESR1
  Gene Name: estrogen receptor 1
  ENSP ID: ENSP00000401995
HNDYMCPATNQCTIDKNRRKSCQACRLRKCYEVGMMKGGFVDLTLHDQVHLLECAWLEILMIGLVWRSMEHPGKLLFAPNLLLDRNQGKCVEGMVEIFDMLLATSSR

SEQ ID NO: 28238 - protein, 595 aa, Homo sapiens [sequence omitted]

SEQ ID NO: 28239 - protein, 115 aa, Homo sapiens
  Payload ID: 5551
  Gene Symbol: ESR1
  Gene Name: estrogen receptor 1
  ENSP ID: ENSP00000411105
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPP

SEQ ID NO: 28240 - protein, 152 aa, Homo sapiens
  Payload ID: 5551
  Gene Symbol: ESR1
  Gene Name: estrogen receptor 1
  ENSP ID: ENSP00000415934
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRT

SEQ ID NO: 28241 - protein, 439 aa, Homo sapiens
  Payload ID: 5552
  Gene Symbol: ESR2
  Gene Name: estrogen receptor 2 (ER beta)
  Uniprot ID: Q92731
  ENSP ID: ENSP00000267525
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGMYPLVTATQDADSSRKLAHLLNAVTDALVWVIAKSGISSQQQSMRLANLLMLLSHVRHASNKGMEHLLNMKCKNVVPVYDLLLEMLNAHVLRGCKSSITGSECSPAEDSKSKEGSQNPQSQ

SEQ ID NO: 28242 - protein, 495 aa, Homo sapiens
  Payload ID: 5552
  Gene Symbol: ESR2
  Gene Name: estrogen receptor 2 (ER beta)
  Uniprot ID: Q92731
  ENSP ID: ENSP00000335551
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHARAEKASQTLTSFGMKMETLLPEATMEQ

SEQ ID NO: 28243 - protein, 530 aa, Homo sapiens
  Payload ID: 5552
  Gene Symbol: ESR2
  Gene Name: estrogen receptor 2 (ER beta)
  Uniprot ID: Q92731
  ENSP ID: ENSP00000343925
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHASNKGMEHLLNMKCKNVVPVYDLLLEMLNAHVLRGCKSSITGSECSPAEDSKSKEGSQNPQSQ

SEQ ID NO: 28244 - protein, 323 aa, Homo sapiens
  Payload ID: 5552
  Gene Symbol: ESR2
  Gene Name: estrogen receptor 2 (ER beta)
  Uniprot ID: Q92731
  ENSP ID: ENSP00000345616
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGMRGNA

SEQ ID NO: 28245 - protein, 495 aa, Homo sapiens; identical to SEQ ID NO: 28242
  Payload ID: 5552
  Gene Symbol: ESR2
  Gene Name: estrogen receptor 2 (ER beta)
  Uniprot ID: Q92731
  ENSP ID: ENSP00000351412

SEQ ID NO: 28246 - protein, 481 aa, Homo sapiens
  Payload ID: 5552
  Gene Symbol: ESR2
  Gene Name: estrogen receptor 2 (ER beta)
  Uniprot ID: Q92731
  ENSP ID: ENSP00000450488
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHARWGEKQFIHLKLS

SEQ ID NO: 28247 - protein, 495 aa, Homo sapiens; identical to SEQ ID NO: 28242
  Payload ID: 5552
  Gene Symbol: ESR2
  Gene Name: estrogen receptor 2 (ER beta)
  Uniprot ID: Q92731
  ENSP ID: ENSP00000450699

SEQ ID NO: 28248 - protein, 472 aa, Homo sapiens
  Payload ID: 5552
  Gene Symbol: ESR2
  Gene Name: estrogen receptor 2 (ER beta)
  Uniprot ID: Q92731
  ENSP ID: ENSP00000451582
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHARYAP

SEQ ID NO: 28249 - protein, 474 aa, Homo sapiens
  Payload ID: 5552
  Gene Symbol: ESR2
  Gene Name: estrogen receptor 2 (ER beta)
  Uniprot ID: Q92731
  ENSP ID: ENSP00000452426
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHARSCVYK

SEQ ID NO: 28250 - protein, 513 aa, Homo sapiens
  Payload ID: 5552
  Gene Symbol: ESR2
  Gene Name: estrogen receptor 2 (ER beta)
  ENSP ID: ENSP00000452485
MDIKNSPSSLNSPSSYNCSQSILPLEHGSIYIPSSYVDSHHEYPAMTFYSPAVMNYSIPSNVTNLEGGPGRQTTSPNVLWPTPGHLSPLVVHRQLSHLYAEPQKSPWCEARSLEHTLPVNRETLKRKVSGNRCASPVTGPGSKRDAHFCAVCSDYASGYHYGVWSCEGCKAFFKRSIQGHNDYICPATNQCTIDKNRRKSCQACRLRKCYEVGMVKCGSRRERCGYRLVRRQRSADEQLHCAGKAKRSGGHAPRVRELLLDALSPEQLVLTLLEAEPPHVLISRPSAPFTEASMMMSLTKLADKELVHMISWAKKIPGFVELSLFDQVRLLESCWMEVLMMGLMWRSIDHPGKLIFAPDLVLDRDEGKCVEGILEIFDMLLATTSRFRELKLQHKEYLCVKAMILLNSSMYPLVTATQDADSSRKLAHLLNAVTDALVWVIAKSGISSQQQSMRLANLLMLLSHVRHASSLSLSWRLFMLREASCHGVRQTPGGAHVSVSRSRSFEACQQPRE

SEQ ID NO: 28251 - protein, 213 aa, Homo sapiens
  Payload ID: 5553
  Gene Symbol: EBAG9
  Gene Name: estrogen receptor binding site associated, antigen, 9
  Uniprot ID: O00559
  ENSP ID: ENSP00000337675
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRQQKLADREKRAAEQQRKKMEKEAQRLMKKEQNKIGVKLS

SEQ ID NO: 28252 - protein, 213 aa, Homo sapiens; identical to SEQ ID NO: 28251
  Payload ID: 5553
  Gene Symbol: EBAG9
  Gene Name: estrogen receptor binding site associated, antigen, 9
  Uniprot ID: O00559
  ENSP ID: ENSP00000379131

SEQ ID NO: 28253 - protein, 258 aa, Homo sapiens
  Payload ID: 5553
  Gene Symbol: EBAG9
  Gene Name: estrogen receptor binding site associated, antigen, 9
  Uniprot ID: O00559
  ENSP ID: ENSP00000432082
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRSRTNVCLLCSLLFHHPTPTSTPYINQSVKIERVSLGQWSYGKSKEQQKLADREKRAAEQQRKKMEKEAQRLMKKEQNKIGVKLS

SEQ ID NO: 28254 - protein, 197 aa, Homo sapiens
  Payload ID: 5553
  Gene Symbol: EBAG9
  Gene Name: estrogen receptor binding site associated, antigen, 9
  ENSP ID: ENSP00000434878
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRQQKLADREKRAAEQQRKKMEKEA

SEQ ID NO: 28255 - protein, 41 aa, Homo sapiens
  Payload ID: 5553
  Gene Symbol: EBAG9
  Gene Name: estrogen receptor binding site associated, antigen, 9
  ENSP ID: ENSP00000435687
MTPTIRKTQKIVIKKREPLNFGIPDGSTGFSSRLAATQDLP

SEQ ID NO: 28256 - protein, 78 aa, Homo sapiens
  Payload ID: 5553
  Gene Symbol: EBAG9
  Gene Name: estrogen receptor binding site associated, antigen, 9
  ENSP ID: ENSP00000435689
MAITQFRLFKFCTCLATVFSFLKRLICRSGRGRKLSGDQITLPTTVDYSSVPKQTDVEEWTSWDEDAPTSVKIEGGNG

SEQ ID NO: 28257 - protein, 153 aa, Homo sapiens
  Payload ID: 5553
  Gene Symbol: EBAG9
  Gene Name: estrogen receptor binding site associated, antigen, 9
  ENSP ID: ENSP00000437214
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSTSHWVGATII

SEQ ID NO: 28258 - protein, 213 aa, Homo sapiens; identical to SEQ ID NO: 28251
  Payload ID: 5553
  Gene Symbol: EBAG9
  Gene Name: estrogen receptor binding site associated, antigen, 9
  Uniprot ID: O00559
  ENSP ID: ENSP00000477645

SEQ ID NO: 28259 - protein, 258 aa, Homo sapiens; identical to SEQ ID NO: 28253
  Payload ID: 5553
  Gene Symbol: EBAG9
  Gene Name: estrogen receptor binding site associated, antigen, 9
  Uniprot ID: O00559
  ENSP ID: ENSP00000477734

SEQ ID NO: 28260 - protein, 423 aa, Homo sapiens
  Payload ID: 5554
  Gene Symbol: ESRRA
  Gene Name: estrogen-related receptor alpha
  Uniprot ID: P11474
  ENSP ID: ENSP00000000442
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 28261 - protein, 423 aa, Homo sapiens; identical to SEQ ID NO: 28260
  Payload ID: 5554
  Gene Symbol: ESRRA
  Gene Name: estrogen-related receptor alpha
  Uniprot ID: P11474
  ENSP ID: ENSP00000384851

SEQ ID NO: 28262 - protein, 422 aa, Homo sapiens
  Payload ID: 5554
  Gene Symbol: ESRRA
  Gene Name: estrogen-related receptor alpha
  Uniprot ID: P11474
  ENSP ID: ENSP00000385971
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEGVRLDRVRGGRQKYKRRPEVDPLPFPGPFPAGPLAVAGGPRKTAPVNALVSHLLVVEPEKLYAMPDPAGPDGHLPAVATLCDLFDREIVVTISWAKSIPGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 28263 - protein, 162 aa, Homo sapiens
  Payload ID: 5554
  Gene Symbol: ESRRA
  Gene Name: estrogen-related receptor alpha
  ENSP ID: ENSP00000439896
MLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSLPLQDELAFAEDLVLDEEGARAAGLGEL

SEQ ID NO: 28264 - protein, 109 aa, Homo sapiens
  Payload ID: 5554
  Gene Symbol: ESRRA
  Gene Name: estrogen-related receptor alpha
  ENSP ID: ENSP00000441970
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQG

SEQ ID NO: 28265 - protein, 198 aa, Homo sapiens
  Payload ID: 5554
  Gene Symbol: ESRRA
  Gene Name: estrogen-related receptor alpha
  ENSP ID: ENSP00000444710
  MOD_RES (1)..(1): Any amino acid
XRPEVDPLPFPGPFPAGPLAVAGGPRKTGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEM

SEQ ID NO: 28266 - protein, 508 aa, Homo sapiens
  Payload ID: 5555
  Gene Symbol: ESRRB
  Gene Name: estrogen-related receptor beta
  Uniprot ID: O95718
  ENSP ID: ENSP00000370270
MSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKVGQEQLRGSPKDERMSSHDGKCPFQSAAFTSRDQSNSPGIPNPRPSSPTPLNERGRQISPSTRTPGGQGKHLWLTM

SEQ ID NO: 28267 - protein, 508 aa, Homo sapiens; identical to SEQ ID NO: 28266
  Payload ID: 5555
  Gene Symbol: ESRRB
  Gene Name: estrogen-related receptor beta
  Uniprot ID: O95718
  ENSP ID: ENSP00000422488

SEQ ID NO: 28268 - protein, 500 aa, Homo sapiens
  Payload ID: 5555
  Gene Symbol: ESRRB
  Gene Name: estrogen-related receptor beta
  Uniprot ID: O95718
  ENSP ID: ENSP00000423004
MSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKAWARADSLQEWRPLEQVPSPLHRATKRQHVHFLTPLPPPPSVAWVGTAQAGYHLEVFLPQRAGWPRAA

SEQ ID NO: 28269 - protein, 508 aa, Homo sapiens
  Payload ID: 5555
  Gene Symbol: ESRRB
  Gene Name: estrogen-related receptor beta
  ENSP ID: ENSP00000424992
MLLNRMSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKVGQEQLRGSPKDERMSSHDGKCPFQSAAFTSRDQSNSPGIPNPRPSSPTPLNERGRQISPSTRTPGGQGKH

SEQ ID NO: 28270 - protein, 433 aa, Homo sapiens
  Payload ID: 5555
  Gene Symbol: ESRRB
  Gene Name: estrogen-related receptor beta
  Uniprot ID: O95718
  ENSP ID: ENSP00000451658
MSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKV

SEQ ID NO: 28271 - protein, 435 aa, Homo sapiens
  Payload ID: 5556
  Gene Symbol: ESRRG
  Gene Name: estrogen-related receptor gamma
  Uniprot ID: P62508
  ENSP ID: ENSP00000352077
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 28272 - protein, 435 aa, Homo sapiens; identical to SEQ ID NO: 28271
  Payload ID: 5556
  Gene Symbol: ESRRG
  Gene Name: estrogen-related receptor gamma
  Uniprot ID: P62508
  ENSP ID: ENSP00000353108

SEQ ID NO: 28273 - protein, 435 aa, Homo sapiens; identical to SEQ ID NO: 28271
  Payload ID: 5556
  Gene Symbol: ESRRG
  Gene Name: estrogen-related receptor gamma
  Uniprot ID: P62508
  ENSP ID: ENSP00000354584

SEQ ID NO: 28274 - protein, 435 aa, Homo sapiens; identical to SEQ ID NO: 28271
  Payload ID: 5556
  Gene Symbol: ESRRG
  Gene Name: estrogen-related receptor gamma
  Uniprot ID: P62508
  ENSP ID: ENSP00000355225

SEQ ID NO: 28275 - protein, 470 aa, Homo sapiens
  Payload ID: 5556
  Gene Symbol: ESRRG
  Gene Name: estrogen-related receptor gamma
  Uniprot ID: P62508
  ENSP ID: ENSP00000355904
MWRECDWGLGAVKSDLACVPSAKRLLCRMSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPLLWSDPADNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 28276 - protein, 435 aa, Homo sapiens; identical to SEQ ID NO: 28271
  Payload ID: 5556
  Gene Symbol: ESRRG
  Gene Name: estrogen-related receptor gamma
  Uniprot ID: P62508
  ENSP ID: ENSP00000355905

SEQ ID NO: 28277 - protein, 435 aa, Homo sapiens; identical to SEQ ID NO: 28271
  Payload ID: 5556
  Gene Symbol: ESRRG
  Gene Name: estrogen-related receptor gamma
  Uniprot ID: P62508
  ENSP ID: ENSP00000355907

SEQ ID NO: 28278 - protein, 435 aa, Homo sapiens; identical to SEQ ID NO: 28271
  Payload ID: 5556
  Gene Symbol: ESRRG
  Gene Name: estrogen-related receptor gamma
  Uniprot ID: P62508
  ENSP ID: ENSP00000375761

SEQ ID NO: 28279 - protein, 458 aa, Homo sapiens
  Payload ID: 5556
  Gene Symbol: ESRRG
  Gene Name: estrogen-related receptor gamma
  Uniprot ID: P62508
  ENSP ID: ENSP00000386171
MDSVELCLPESFSLHYEEELLCRMSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 28280 - protein, 435 aa, Homo sapiens; identical to SEQ ID NO: 28271
  Payload ID: 5556
  Gene Symbol: ESRRG
  Gene Name: estrogen-related receptor gamma
  Uniprot ID: P62508
  ENSP ID: ENSP00000417374

SEQ ID NO: 28281 - protein, 92 aa, Homo sapiens
  Payload ID: 5556
  Gene Symbol: ESRRG
  Gene Name: estrogen-related receptor gamma
  ENSP ID: ENSP00000417900
MSNKDRHIDSSCSSFIKTEPSSPASLTDSVNHHSPGGSSDASGSYSSTMNGHQNGLDSPPLYPSAPILGGSGPVRKLYDDCSSTIVEDPQTK

SEQ ID NO: 28282 - protein, 396 aa, Homo sapiens
  Payload ID: 5556
  Gene Symbol: ESRRG
  Gene Name: estrogen-related receptor gamma
  Uniprot ID: P62508
  ENSP ID: ENSP00000418629
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 28283 - protein, 50 aa, Homo sapiens
  Payload ID: 5556
  Gene Symbol: ESRRG
  Gene Name: estrogen-related receptor gamma
  ENSP ID: ENSP00000418895
MSNKDRHIDSSCSSFIKTEPSSPASLTDSVNHHSPGGSSDASGSYSSTMN

SEQ ID NO: 28284 - protein, 435 aa, Homo sapiens; identical to SEQ ID NO: 28271
  Payload ID: 5556
  Gene Symbol: ESRRG
  Gene Name: estrogen-related receptor gamma
  Uniprot ID: P62508
  ENSP ID: ENSP00000419155

SEQ ID NO: 28285 - protein, 354 aa, Homo sapiens
  Payload ID: 5556
  Gene Symbol: ESRRG
  Gene Name: estrogen-related receptor gamma
  ENSP ID: ENSP00000419514
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANS

SEQ ID NO: 28286 - protein, 435 aa, Homo sapiens; identical to SEQ ID NO: 28271
  Payload ID: 5556
  Gene Symbol: ESRRG
  Gene Name: estrogen-related receptor gamma
  Uniprot ID: P62508
  ENSP ID: ENSP00000419594

SEQ ID NO: 28287 - protein, 55 aa, Homo sapiens
  Payload ID: 5556
  Gene Symbol: ESRRG
  Gene Name: estrogen-related receptor gamma
  ENSP ID: ENSP00000420370
MSNKDRHIDSSCSSFIKTEPSSPASLTDSVNHHSPGGSSDASGSYSSTMNGHQNG

SEQ ID NO: 28288 - protein, 47 aa, Homo sapiens
  Payload ID: 5556
  Gene Symbol: ESRRG
  Gene Name: estrogen-related receptor gamma
  ENSP ID: ENSP00000466343
MWRECDWGLGAVKSDLACVPSAKRREPLAREETGLLMNANRRSSICA

SEQ ID NO: 28289 - protein, 435 aa, Homo sapiens; identical to SEQ ID NO: 28271
  Payload ID: 5556
  Gene Symbol: ESRRG
  Gene Name: estrogen-related receptor gamma
  Uniprot ID: P62508
  ENSP ID: ENSP00000481528

SEQ ID NO: 28290 - protein, 406 aa, Homo sapiens
  Payload ID: 5557
  Gene Symbol: ESX1
  Gene Name: ESX homeobox 1
  Uniprot ID: Q8N693
  ENSP ID: ENSP00000361669
MESLRGYTHSDIGYRSLAVGEDIEEVNDEKLTVTSLMARGGEDEENTRSKPEYGTEAENNVGTEGSVPSDDQDREGGGGHEPEQQQEEPPLTKPEQQQEEPPLLELKQEQEEPPQTTVEGPQPAEGPQTAEGPQPPERKRRRRTAFTQFQLQELENFFDESQYPDVVARERLAARLNLTEDRVQVWFQNRRAKWKRNQRVLMLRNTATADLAHPLDMFLGGAYYAAPALDPALCVHLVPQLPRPPVLPVPPMPPRPPMVPMPPRPPIAPMPPMAPVPPGSRMAPVPPGPRMAPVPPWPPMAPVPPWPPMAPVPTGPPMAPVPPGPPMARVPPGPPMARVPPGPPMAPLPPGPPMAPLPPGPPMAPLPPGPPMAPLPPRSHVPHTGLAPVHITWAPVINSYYACPFF

SEQ ID NO: 28291 - protein, 452 aa, Homo sapiens
  Payload ID: 5558
  Gene Symbol: ETNK1
  Gene Name: ethanolamine kinase 1
  Uniprot ID: Q9HBU6
  ENSP ID: ENSP00000266517
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFRLIARQLAKIHAIHAHNGWIPKSNLWLKMGKYFSLIPTGFADEDINKRFLSDIPSSQILQEEMTWMKEILSNLGSPVVLCHNDLLCKNIIYNEKQGDVQFIDYEYSGYNYLAYDIGNHFNEFAGVSDVDYSLYPDRELQSQWLRAYLEAYKEFKGFGTEVTEKEVEILFIQVNQFALASHFFWGLWALIQAKYSTIEFDFLGYAIVRFNQYFKMKPEVTALKVPE

SEQ ID NO: 28292 - protein, 258 aa, Homo sapiens
  Payload ID: 5558
  Gene Symbol: ETNK1
  Gene Name: ethanolamine kinase 1
  Uniprot ID: Q9HBU6
  ENSP ID: ENSP00000334041
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFSLSSLTLCKGKTTRCFGLTGCRGSRLLLSFF

SEQ ID NO: 28293 - protein, 82 aa, Homo sapiens
  Payload ID: 5558
  Gene Symbol: ETNK1
  Gene Name: ethanolamine kinase 1
  ENSP ID: ENSP00000439614
  MOD_RES (1)..(1): Any amino acid
XLSAPAVLVVAVAVVVVVVSAVAWAMANYIHVPPGSPEVPKLNVTVQDQEEHRCREGALSLLQHLRPHWDPQEVTLQKPLRK

SEQ ID NO: 28294 - protein, 425 aa, Homo sapiens
  Payload ID: 5558
  Gene Symbol: ETNK1
  Gene Name: ethanolamine kinase 1
  ENSP ID: ENSP00000446292
  MOD_RES (1)..(1): Any amino acid
XDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFRLIARQLAKIHAIHAHNGWIPKSNLWLKMGKYFSLIPTGFADEDINKRFLSDIPSSQILQEEMTWMKEILSNLGSPVVLCHNDLLCKNIIYNEKQGDVQFIDYEYSGYNYLAYDIGNHFNEFAGVSDVDYSLYPDRELQSQWLRAYLEAYKEFKGFGTEVTEKEVEILFIQVNQFALGENLNFIIGNKYCQLFSLKWLLISFGDCGL

SEQ ID NO: 28295 - protein, 68 aa, Homo sapiens
  Payload ID: 5559
  Gene Symbol: ETNK2
  Gene Name: ethanolamine kinase 2
  ENSP ID: ENSP00000356165
MAVTPREVQRLYVQVNKFALASHFFWALWALIQNQYSTIDFDFLRYAVIRFNQYFKVKPQASALEMPK

SEQ ID NO: 28296 - protein, 394 aa, Homo sapiens
  Payload ID: 5559
  Gene Symbol: ETNK2
  Gene Name: ethanolamine kinase 2
  Uniprot ID: Q9NVF9
  ENSP ID: ENSP00000356169
MAVPPSAPQPRASFHLRRHTPCPQCSWGMEEKAAASASCREPPGPPRAAAVAYFGISVDPDDILPGALRLIQELRPHWKPEQVRTKRFTDGITNKLVACYVEEDMQDCVLVRVYGERTELLVDRENEVRNFQLLRAHSCAPKLYCTFQNGLCYEYMQGVALEPEHIREPRLFRLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALGPSCVSSTMTASLQCCRVGNRHGEIARLTLSGLFPGVSLLLGSLGPHPEPVLHHRL

SEQ ID NO: 28297 - protein, 386 aa, Homo sapiens
  Payload ID: 5559
  Gene Symbol: ETNK2
  Gene Name: ethanolamine kinase 2
  Uniprot ID: Q9NVF9
  ENSP ID: ENSP00000356170
MAVPPSAPQPRASFHLRRHTPCPQCSWGMEEKAAASASCREPPGPPRAAAVAYFGISVDPDDILPGALRLIQELRPHWKPEQVRTKRFTDGITNKLVACYVEEDMQDCVLVRVYGERTELLVDRENEVRNFQLLRAHSCAPKLYCTFQNGLCYEYMQGVALEPEHIREPRLFRLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 28298 - protein, 12 aa, Homo sapiens
  Payload ID: 5559
  Gene Symbol: ETNK2
  Gene Name: ethanolamine kinase 2
  ENSP ID: ENSP00000394618
MQDCVLVRVYGE

SEQ ID NO: 28299 - protein, 192 aa, Homo sapiens
  Payload ID: 5559
  Gene Symbol: ETNK2
  Gene Name: ethanolamine kinase 2
  ENSP ID: ENSP00000398091
NSFSSLLLRPSFCRTCAPKGLAIIPSLALWLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNK

SEQ ID NO: 28300 - protein, 217 aa, Homo sapiens
  Payload ID: 5559
  Gene Symbol: ETNK2
  Gene Name: ethanolamine kinase 2
  ENSP ID: ENSP00000405497
RRLGGGTAEGKTGRGLGGPSWDTGPRAMGSLSRPSFSDRLIALEMAKIHTIHANGSLPKPILWHKMHNYFTLVKNEINPSLSADVPKVEVLERELAWLKEHLSQLESPVVFCHNDLLCKNIIYDSIKGHVRFIDYEYAGYNYQAFDIGNHFNEFAGVNEVDYCLYPARETQLQWLHYYLQAQKGMAVTPREVQRLYVQVNKFALASHFFWALWALIQ

SEQ ID NO: 28301 - protein, 147 aa, Homo sapiens
  Payload ID: 5559
  Gene Symbol: ETNK2
  Gene Name: ethanolamine kinase 2
  ENSP ID: ENSP00000406241
YGERTELLVDRENEVRNFQLLRAHSCAPKLYCTFQNGLCYEYMQGVALEPEHIREPRLFSLSADVPKVEVLERELAWLKEHLSQLESPVVFCHNDLLCKNIIYDSIKGHVRFIDYEYAGYNYQAFDIGNHFNEFAGVNEVDYCLYPA

SEQ ID NO: 28302 - protein, 149 aa, Homo sapiens
  Payload ID: 5559
  Gene Symbol: ETNK2
  Gene Name: ethanolamine kinase 2
  ENSP ID: ENSP00000410580
  MOD_RES (1)..(1): Any amino acid
XQGFGWLVSWLHGAVLPAGTWTSKSHVRFIDYEYAGYNYQAFDIGNHFNEFAGVNEVDYCLYPARETQLQWLHYYLQAQKGMAVTPREVQRLYVQVNKFALASHFFWALWALIQNQYSTIDFDFLRYAVIRFNQYFKVKPQASALEMPK

SEQ ID NO: 28303 - protein, 499 aa, Homo sapiens
  Payload ID: 5560
  Gene Symbol: ETNPPL
  Gene Name: ethanolamine-phosphate phospho-lyase
  Uniprot ID: Q8TBG4
  ENSP ID: ENSP00000296486
MCELYSKRDTLGLRKKHIGPSCKVFFASDPIKIVRAQRQYMFDENGEQYLDCINNVAHVGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 28304 - protein, 493 aa, Homo sapiens
  Payload ID: 5560
  Gene Symbol: ETNPPL
  Gene Name: ethanolamine-phosphate phospho-lyase
  Uniprot ID: Q8TBG4
  ENSP ID: ENSP00000392269
MCELYSKRDTLGLRKKHIGPSCKVFFASDPIKIVRAQRQYMFDENGEQYLDCINNVAHGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 28305 - protein, 60 aa, Homo sapiens
  Payload ID: 5560
  Gene Symbol: ETNPPL
  Gene Name: ethanolamine-phosphate phospho-lyase
  ENSP ID: ENSP00000421217
MELLNTNSRFLHDNIVEYAKRLSATLPEKLSVCYFTNSGSEANDLALRLARQFRGHQDVI

SEQ ID NO: 28306 - protein, 64 aa, Homo sapiens
  Payload ID: 5560
  Gene Symbol: ETNPPL
  Gene Name: ethanolamine-phosphate phospho-lyase
  ENSP ID: ENSP00000422050
MCELYSKRDTLGLRKKHIGPSCKVFFASDPIKIVRAQRQYMFDENGEQYLDCINNVAHDPKPTT

SEQ ID NO: 28307 - protein, 459 aa, Homo sapiens
  Payload ID: 5560
  Gene Symbol: ETNPPL
  Gene Name: ethanolamine-phosphate phospho-lyase
  ENSP ID: ENSP00000423240
MFDENGEQYLDCINNVAHVGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 28308 - protein, 70 aa, Homo sapiens
  Payload ID: 5560
  Gene Symbol: ETNPPL
  Gene Name: ethanolamine-phosphate phospho-lyase
  ENSP ID: ENSP00000426525
MGHCHPGVVKAALKQMELLNTNSRFLHDNIVEYAKRLSATLPEKLSVCYFTNSGSEANDLALRLARQFRG

SEQ ID NO: 28309 - protein, 49 aa, Homo sapiens
  Payload ID: 5560
  Gene Symbol: ETNPPL
  Gene Name: ethanolamine-phosphate phospho-lyase
  ENSP ID: ENSP00000426871
MCELYSKRDTLGLRKKHIGGTLSPRSGQSCPETDGTAKYKFSIPPRQHC

SEQ ID NO: 28310 - protein, 441 aa, Homo sapiens
  Payload ID: 5560
  Gene Symbol: ETNPPL
  Gene Name: ethanolamine-phosphate phospho-lyase
  Uniprot ID: Q8TBG4
  ENSP ID: ENSP00000427065
MGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 28311 - protein, 397 aa, Homo sapiens
  Payload ID: 5561
  Gene Symbol: EPT1
  Gene Name: ethanolaminephosphotransferase 1
  Uniprot ID: Q9C0D9
  ENSP ID: ENSP00000260585
  MOD_RES (387)..(387): Selenocysteine
MAGYEYVSPEQLAGFDKYKYSAVDTNPLSLYVMHPFWNTIVKVFPTWLAPNLITFSGFLLVVFNFLLMAYFDPDFYASAPGHKHVPDWVWIVVGILNFVAYTLDGVDGKQARRTNSSTPLGELFDHGLDSWSCVYFVVTVYSIFGRGSTGVSVFVLYLLLWVVLFSFILSHWEKYNTGILFLPWGYDISQVTISFVYIVTAVVGVEAWYEPFLFNFLYRDLFTAMIIGCALCVTLPMSLLNFFRSYKNNTLKLNSVYEAMVPLFSPCLLFILSTAWILWSPSDILELHPRVFYFMVGTAFANSTCQLIVCQMSSTRCPTLNWLLVPLFLVVLVVNLGVASYVESILLYTLTTAFTLAHIHYGVRVVKQLSSHFQIYPFSLRKPNSDXLGMEEKNIGL

SEQ ID NO: 28312 - protein, 180 aa, Homo sapiens
  Payload ID: 5561
  Gene Symbol: EPT1
  Gene Name: ethanolaminephosphotransferase 1
  ENSP ID: ENSP00000391804
MAGYEYVSPEQLAGFDKYKYSAVDTNPLSLYVMHPFWNTIVKVFPTWLAPNLITFSGFLLVVFNFLLMAYFDPDFYASAPGHKHVPDWVWIVVGILNFVAYTLGCALCVTLPMSLLNFFRSYKNNTLKLNSVYEAMVPLFSPCLLFILSTAWILWSPSDILELHPRVFYFMVGTAFANST

SEQ ID NO: 28313 - protein, 118 aa, Homo sapiens
  Payload ID: 5561
  Gene Symbol: EPT1
  Gene Name: ethanolaminephosphotransferase 1
  ENSP ID: ENSP00000415280
MHPFWNTIVKVFPTWLAPNLITFSGFLLVVFNFLLMAYFDPDFYASAPGHKHVPDWVWIVVGILNFVAYTLDGVDGKQARRTNSSTPLGELFDHGLDSWSCVYFVVTVYSIFGRGSTG

SEQ ID NO: 28314 - protein, 396 aa, Homo sapiens
  Payload ID: 5561
  Gene Symbol: EPT1
  Gene Name: ethanolaminephosphotransferase 1
  ENSP ID: ENSP00000479973
MAGYEYVSPEQLAGFDKYKYSAVDTNPLSLYVMHPFWNTIVKVFPTWLAPNLITFSGFLLVVFNFLLMAYFDPDFYASAPGHKHVPDWVWIVVGILNFVAYTLDGVDGKQARRTNSSTPLGELFDHGLDSWSCVYFVVTVYSIFGRGSTGVSVFVLYLLLWVVLFSFILSHWEKYNTGILFLPWGYDISQVTISFVYIVTAVVGVEAWYEPFLFNFLYRDLFTAMIIGCALCVTLPMSLLNFFRSYKNNTLKLNSVYEAMVPLFSPCLLFILSTAWILWSPSDILELHPRVFYFMVGTAFANSTCQLIVCQMSSTRCPTLNWLLVPLFLVVLVVNLGVASYVESILLYTLTTAFTLAHIHYGVRVVKQLSSHFQIYPFSLRKPNSDLGMEEKNIGL

SEQ ID NO: 28315 - protein, 254 aa, Homo sapiens
  Payload ID: 5562
  Gene Symbol: ETHE1
  Gene Name: ethylmalonic encephalopathy 1
  Uniprot ID: O95571
  ENSP ID: ENSP00000292147
MAEAVLRVARRQLSQRGGSGAPILLRQMFEPVSCTFTYLLGDRESREAVLIDPVLETAPRDAQLIKELGLRLLYAVNTHCHADHITGSGLLRSLLPGCQSVISRLSGAQADLHIEDGDSIRFGRFALETRASPGHTPGCVTFVLNDHSMAFTGDALLIRGCGRTDFQQGCAKTLYHSVHEKIFTLPGDCLIYPAHDYHGFTVSTVEEERTLNPRLTLSCEEFVKIMGNLNLPKPQQIDFAVPANMRCGVQTPTA

SEQ ID NO: 28316 - protein, 51 aa, Homo sapiens
  Payload ID: 5562
  Gene Symbol: ETHE1
  Gene Name: ethylmalonic encephalopathy 1
  ENSP ID: ENSP00000468964
MAEAVLRVARRQLSQRGGSGAPILLRQVRVAGPRRGLLGTRRQQGRNSGVS

SEQ ID NO: 28317 - protein, 260 aa, Homo sapiens
  Payload ID: 5562
  Gene Symbol: ETHE1
  Gene Name: ethylmalonic encephalopathy 1
  ENSP ID: ENSP00000469037
MAEAVLRVARRQLSQRGGSGAPILLRQMFEPVSCTFTYLLGDRESREAVLIDPVLETAPRDAQLIKELGLRLLYAVNTHCHADHITGSGLLRSLLPGCQSVISRLSGAQADLHIEDGDSIRFGRFALETRASPGHTPGCVTFVLNDHSMAFTGDALLIRGCGRTDFQQGCAKTLYHSVHEKIFTLPGDCLIYPAHDYHGFTVSTVEEERTLNPRLTLSCEEFVKIMGNLNLPKPQQIGEQLGTWTSGSERGGAGVLDSWV

SEQ ID NO: 28318 - protein, 95 aa, Homo sapiens
  Payload ID: 5562
  Gene Symbol: ETHE1
  Gene Name: ethylmalonic encephalopathy 1
  ENSP ID: ENSP00000469219
MAEAVLRVARRQLSQRGGSGAPILLRQMFEPVSCTFTYLLGDRESREAVLIDPVLETAPRDAQLIKELGLRLLYAGVGDQGQPWPHPRLCHLRPE

SEQ ID NO: 28319 - protein, 95 aa, Homo sapiens; identical to SEQ ID NO: 28318
  Payload ID: 5562
  Gene Symbol: ETHE1
  Gene Name: ethylmalonic encephalopathy 1
  ENSP ID: ENSP00000469652

SEQ ID NO: 28320 - protein, 145 aa, Homo sapiens
  Payload ID: 5563
  Gene Symbol: ECHDC1
  Gene Name: ethylmalonyl-CoA decarboxylase 1
  Uniprot ID: Q9NTX5
  ENSP ID: ENSP00000357272
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPETSFNKCCAGSRLGIGWRSRIYYSM

SEQ ID NO: 28321 - protein, 145 aa, Homo sapiens; identical to SEQ ID NO: 28320
  Payload ID: 5563
  Gene Symbol: ECHDC1
  Gene Name: ethylmalonyl-CoA decarboxylase 1
  Uniprot ID: Q9NTX5
  ENSP ID: ENSP00000357274

SEQ ID NO: 28322 - protein, 125 aa, Homo sapiens
  Payload ID: 5563
  Gene Symbol: ECHDC1
  Gene Name: ethylmalonyl-CoA decarboxylase 1
  ENSP ID: ENSP00000357278
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEANFL

SEQ ID NO: 28323 - protein, 76 aa, Homo sapiens
  Payload ID: 5563
  Gene Symbol: ECHDC1
  Gene Name: ethylmalonyl-CoA decarboxylase 1
  ENSP ID: ENSP00000396096
  MOD_RES (1)..(1): Any amino acid
XMLQLLEKVIELENWTEGKGLIVRGAKNTFSSGSDLNAVKSLGTPEDGMAVCMFMQNTLTRFMSRMCGEVVCIQRR

SEQ ID NO: 28324 - protein, 255 aa, Homo sapiens
  Payload ID: 5563
  Gene Symbol: ECHDC1
  Gene Name: ethylmalonyl-CoA decarboxylase 1
  ENSP ID: ENSP00000399233
  MOD_RES (1)..(1): Any amino acid
XTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEESCRWNTEFLYTLHPVSPFINILYSYGWNGRMHVHAKHLNKIYEVKKQRGKILLGLSRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQE

SEQ ID NO: 28325 - protein, 301 aa, Homo sapiens
  Payload ID: 5563
  Gene Symbol: ECHDC1
  Gene Name: ethylmalonyl-CoA decarboxylase 1
  Uniprot ID: Q9NTX5
  ENSP ID: ENSP00000401751
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 28326 - protein, 301 aa, Homo sapiens; identical to SEQ ID NO: 28325
  Payload ID: 5563
  Gene Symbol: ECHDC1
  Gene Name: ethylmalonyl-CoA decarboxylase 1
  Uniprot ID: Q9NTX5
  ENSP ID: ENSP00000402492

SEQ ID NO: 28327 - protein, 226 aa, Homo sapiens
  Payload ID: 5563
  Gene Symbol: ECHDC1
  Gene Name: ethylmalonyl-CoA decarboxylase 1
  Uniprot ID: Q9NTX5
  ENSP ID: ENSP00000404866
MMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 28328 - protein, 125 aa, Homo sapiens
  Payload ID: 5563
  Gene Symbol: ECHDC1
  Gene Name: ethylmalonyl-CoA decarboxylase 1
  ENSP ID: ENSP00000420711
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEGDFL

SEQ ID NO: 28329 - protein, 100 aa, Homo sapiens
  Payload ID: 5563
  Gene Symbol: ECHDC1
  Gene Name: ethylmalonyl-CoA decarboxylase 1
  ENSP ID: ENSP00000432265
  MOD_RES (1)..(1): Any amino acid
XTPEVKKQRGKILLGLSRLPLISVALVQGWALGGGAEFTTACDFRLMTPESKIRFVHKEMGIIPSWGGTTRLVEIIGSRQALKVLSGALKLDSKNALNIG

SEQ ID NO: 28330 - protein, 34 aa, Homo sapiens
  Payload ID: 5563
  Gene Symbol: ECHDC1
  Gene Name: ethylmalonyl-CoA decarboxylase 1
  ENSP ID: ENSP00000433015
  MOD_RES (1)..(1): Any amino acid
XFMRLPLISVALVQGWALGGGAEFTTACDFSFRH

SEQ ID NO: 28331 - protein, 83 aa, Homo sapiens
  Payload ID: 5563
  Gene Symbol: ECHDC1
  Gene Name: ethylmalonyl-CoA decarboxylase 1
  ENSP ID: ENSP00000433874
MAKSLLKTASLSGRTKLLHQTGLSLYSTSHGFYEEEVKKTLQQFPGGSIDLQKEDNGIGILTLNNPSRMNAFSEFREISLYQC

SEQ ID NO: 28332 - protein, 135 aa, Homo sapiens
  Payload ID: 5563
  Gene Symbol: ECHDC1
  Gene Name: ethylmalonyl-CoA decarboxylase 1
  ENSP ID: ENSP00000434143
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLT

SEQ ID NO: 28333 - protein, 301 aa, Homo sapiens; identical to SEQ ID NO: 28325
  Payload ID: 5563
  Gene Symbol: ECHDC1
  Gene Name: ethylmalonyl-CoA decarboxylase 1
  Uniprot ID: Q9NTX5
  ENSP ID: ENSP00000434908

SEQ ID NO: 28334 - protein, 179 aa, Homo sapiens
  Payload ID: 5563
  Gene Symbol: ECHDC1
  Gene Name: ethylmalonyl-CoA decarboxylase 1
  ENSP ID: ENSP00000435068
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEESCRWNTEFLYTLHPVSPFINILYSYGWNGRMHVHAKHLNKIYETSFNKCCAGSRLGI

SEQ ID NO: 28335 - protein, 151 aa, Homo sapiens
  Payload ID: 5563
  Gene Symbol: ECHDC1
  Gene Name: ethylmalonyl-CoA decarboxylase 1
  ENSP ID: ENSP00000435502
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGW

SEQ ID NO: 28336 - protein, 70 aa, Homo sapiens
  Payload ID: 5563
  Gene Symbol: ECHDC1
  Gene Name: ethylmalonyl-CoA decarboxylase 1
  Uniprot ID: Q9NTX5
  ENSP ID: ENSP00000436109
MMLQLLEKVIELENWTEGKGLIVRGAKNTFSSGSDLNAVKSLGTPETSFNKCCAGSRLGIGWRSRIYYSM

SEQ ID NO: 28337 - protein, 307 aa, Homo sapiens
  Payload ID: 5563
  Gene Symbol: ECHDC1
  Gene Name: ethylmalonyl-CoA decarboxylase 1
  Uniprot ID: Q9NTX5
  ENSP ID: ENSP00000436585
MALKQEMAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 28338 - protein, 139 aa, Homo sapiens
  Payload ID: 5563
  Gene Symbol: ECHDC1
  Gene Name: ethylmalonyl-CoA decarboxylase 1
  ENSP ID: ENSP00000436703
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMR

SEQ ID NO: 28339 - protein, 340 aa, Homo sapiens
  Payload ID: 5564
  Gene Symbol: EI24
  Gene Name: etoposide induced 2.4
  Uniprot ID: O14681
  ENSP ID: ENSP00000278903
MADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 28340 - protein, 262 aa, Homo sapiens
  Payload ID: 5564
  Gene Symbol: EI24
  Gene Name: etoposide induced 2.4
  ENSP ID: ENSP00000431633
MADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKVAAFSLSSFLYSLSAPMKQRPLAKHISSSCASSPWWSS

SEQ ID NO: 28341 - protein, 125 aa, Homo sapiens
  Payload ID: 5564
  Gene Symbol: EI24
  Gene Name: etoposide induced 2.4
  ENSP ID: ENSP00000433376
MADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSI

SEQ ID NO: 28342 - protein, 187 aa, Homo sapiens
  Payload ID: 5564
  Gene Symbol: EI24
  Gene Name: etoposide induced 2.4
  ENSP ID: ENSP00000435034
MADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQ

SEQ ID NO: 28343 - protein, 91 aa, Homo sapiens
  Payload ID: 5564
  Gene Symbol: EI24
  Gene Name: etoposide induced 2.4
  ENSP ID: ENSP00000435225
MADSVKTFLQDLARLDARIQQKREEQRRRRASSVLAQRRAQSIERKQESEPRIVSRIFQCCAWNGGVFWFSLLLFYRVFIPVLQSVTARII

SEQ ID NO: 28344 - protein, 217 aa, Homo sapiens
  Payload ID: 5564
  Gene Symbol: EI24
  Gene Name: etoposide induced 2.4
  ENSP ID: ENSP00000435923
MADSVKTFLQDLARGIKDSIWGICTISKLDARIQQKREEQRRRRASSVLAQRRAQSIERKQERRILALSPSCHLRLPWCNLSLLQPLPPRSKQFFCLSEPAGWKYSEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADM

SEQ ID NO: 28345 - protein, 14 aa, Homo sapiens
  Payload ID: 5564
  Gene Symbol: EI24
  Gene Name: etoposide induced 2.4
  ENSP ID: ENSP00000436130
MADSVKTFLQDLAR

SEQ ID NO: 28346 - protein, 167 aa, Homo sapiens
  Payload ID: 5564
  Gene Symbol: EI24
  Gene Name: etoposide induced 2.4
  ENSP ID: ENSP00000477849
MLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 28347 - protein, 41 aa, Homo sapiens
  Payload ID: 5564
  Gene Symbol: EI24
  Gene Name: etoposide induced 2.4
  ENSP ID: ENSP00000479171
MADSVKTFLQDLARMLESSKRERSSVEEGQVVSWHREEPRV

SEQ ID NO: 28348 - protein, 326 aa, Homo sapiens
  Payload ID: 5564
  Gene Symbol: EI24
  Gene Name: etoposide induced 2.4
  Uniprot ID: O14681
  ENSP ID: ENSP00000479943
MADSVKTFLQDLARLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 28349 - protein, 167 aa, Homo sapiens; identical to SEQ ID NO: 28346
  Payload ID: 5564
  Gene Symbol: EI24
  Gene Name: etoposide induced 2.4
  ENSP ID: ENSP00000480094

SEQ ID NO: 28350 - protein, 340 aa, Homo sapiens; identical to SEQ ID NO: 28339
  Payload ID: 5564
  Gene Symbol: EI24
  Gene Name: etoposide induced 2.4
  Uniprot ID: O14681
  ENSP ID: ENSP00000484510

SEQ ID NO: 28351 - protein, 300 aa, Homo sapiens
  Payload ID: 5565
  Gene Symbol: EHF
  Gene Name: ets homologous factor
  Uniprot ID: Q9NZC4
  ENSP ID: ENSP00000257831
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 28352 - protein, 277 aa, Homo sapiens
  Payload ID: 5565
  Gene Symbol: EHF
  Gene Name: ets homologous factor
  Uniprot ID: Q9NZC4
  ENSP ID: ENSP00000399733
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 28353 - protein, 158 aa, Homo sapiens
  Payload ID: 5565
  Gene Symbol: EHF
  Gene Name: ets homologous factor
  ENSP ID: ENSP00000432460
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTV

SEQ ID NO: 28354 - protein, 166 aa, Homo sapiens
  Payload ID: 5565
  Gene Symbol: EHF
  Gene Name: ets homologous factor
  ENSP ID: ENSP00000432905
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVAESPDMKK

SEQ ID NO: 28355 - protein, 300 aa, Homo sapiens; identical to SEQ ID NO: 28351
  Payload ID: 5565
  Gene Symbol: EHF
  Gene Name: ets homologous factor
  Uniprot ID: Q9NZC4
  ENSP ID: ENSP00000433508

SEQ ID NO: 28356 - protein, 173 aa, Homo sapiens
  Payload ID: 5565
  Gene Symbol: EHF
  Gene Name: ets homologous factor
  ENSP ID: ENSP00000434395
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISM

SEQ ID NO: 28357 - protein, 322 aa, Homo sapiens
  Payload ID: 5565
  Gene Symbol: EHF
  Gene Name: ets homologous factor
  Uniprot ID: Q9NZC4
  ENSP ID: ENSP00000435835
MGLPERRGLVLLLSLAEILFKIMILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 28358 - protein, 300 aa, Homo sapiens; identical to SEQ ID NO: 28351
  Payload ID: 5565
  Gene Symbol: EHF
  Gene Name: ets homologous factor
  Uniprot ID: Q9NZC4
  ENSP ID: ENSP00000435837

SEQ ID NO: 28359 - protein, 126 aa, Homo sapiens
  Payload ID: 5565
  Gene Symbol: EHF
  Gene Name: ets homologous factor
  ENSP ID: ENSP00000436158
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGDSLFLCLSLPC

SEQ ID NO: 28360 - protein, 126 aa, Homo sapiens; identical to SEQ ID NO: 28359
  Payload ID: 5565
  Gene Symbol: EHF
  Gene Name: ets homologous factor
  ENSP ID: ENSP00000436357

SEQ ID NO: 28361 - protein, 459 aa, Homo sapiens
  Payload ID: 5566
  Gene Symbol: ETV1
  Gene Name: ets variant 1
  Uniprot ID: P50549
  ENSP ID: ENSP00000242066
MDGFYDQQVPYMVTNSQRGRNCNEKPTNVRKRKFINRDLAHDSEELFQDLSQLQETWLAEVAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28362 - protein, 374 aa, Homo sapiens
  Payload ID: 5566
  Gene Symbol: ETV1
  Gene Name: ets variant 1
  Uniprot ID: P50549
  ENSP ID: ENSP00000382293
MLQDLSASVFFPPCSQHRTLAQVPDNDEQFVPDYQAESLAFHGLPLKIKKEPHSPCSEISSACSQEQPFKFSYGEKCLYNVRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28363 - protein, 491 aa, Homo sapiens
  Payload ID: 5566
  Gene Symbol: ETV1
  Gene Name: ets variant 1
  ENSP ID: ENSP00000384085
MSGRGDGGQQQLLHSKFLAGFVCHIEKNESQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28364 - protein, 437 aa, Homo sapiens
  Payload ID: 5566
  Gene Symbol: ETV1
  Gene Name: ets variant 1
  Uniprot ID: P50549
  ENSP ID: ENSP00000384138
MLQDLSASVFFPPCSQHRTLAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28365 - protein, 454 aa, Homo sapiens
  Payload ID: 5566
  Gene Symbol: ETV1
  Gene Name: ets variant 1
  Uniprot ID: P50549
  ENSP ID: ENSP00000385381
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28366 - protein, 477 aa, Homo sapiens
  Payload ID: 5566
  Gene Symbol: ETV1
  Gene Name: ets variant 1
  Uniprot ID: P50549
  ENSP ID: ENSP00000385551
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28367 - protein, 459 aa, Homo sapiens; identical to SEQ ID NO: 28361
  Payload ID: 5566
  Gene Symbol: ETV1
  Gene Name: ets variant 1
  Uniprot ID: P50549
  ENSP ID: ENSP00000385686

SEQ ID NO: 28368 - protein, 123 aa, Homo sapiens
  Payload ID: 5566
  Gene Symbol: ETV1
  Gene Name: ets variant 1
  ENSP ID: ENSP00000391043
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSA

SEQ ID NO: 28369 - protein, 288 aa, Homo sapiens
  Payload ID: 5566
  Gene Symbol: ETV1
  Gene Name: ets variant 1
  ENSP ID: ENSP00000393078
MLQDLSASVFFPPCSQHRTLVAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLD

SEQ ID NO: 28370 - protein, 173 aa, Homo sapiens
  Payload ID: 5566
  Gene Symbol: ETV1
  Gene Name: ets variant 1
  ENSP ID: ENSP00000394710
MLQDLSASVFFPPCSQHRTLAQVPDNDEQFVPDYQAESLAFHGLPLKIKKEPHSPCSEISSACSQEQPFKFSYGEKCLYNVRFRRQLSEPCNSFPPLPTMPREGRPMYQRQMSEPNIPFPPQGFKQEYHDPVYEHNTMVGSAASQSFPPPLMIKQEPRDFAYDSEVPSCHSIY

SEQ ID NO: 28371 - protein, 477 aa, Homo sapiens; identical to SEQ ID NO: 28366
  Payload ID: 5566
  Gene Symbol: ETV1
  Gene Name: ets variant 1
  Uniprot ID: P50549
  ENSP ID: ENSP00000405327

SEQ ID NO: 28372 - protein, 20 aa, Homo sapiens
  Payload ID: 5566
  Gene Symbol: ETV1
  Gene Name: ets variant 1
  ENSP ID: ENSP00000406931
MDGFYDQQVPYMVTNSQRGR

SEQ ID NO: 28373 - protein, 95 aa, Homo sapiens
  Payload ID: 5566
  Gene Symbol: ETV1
  Gene Name: ets variant 1
  ENSP ID: ENSP00000410819
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSP

SEQ ID NO: 28374 - protein, 419 aa, Homo sapiens
  Payload ID: 5566
  Gene Symbol: ETV1
  Gene Name: ets variant 1
  Uniprot ID: P50549
  ENSP ID: ENSP00000411626
MLQDLSASVFFPPCSQHRTLVAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28375 - protein, 367 aa, Homo sapiens
  Payload ID: 5566
  Gene Symbol: ETV1
  Gene Name: ets variant 1
  ENSP ID: ENSP00000413836
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGFSNVALSVIILRGICLSTDHRRHQTRARNVSGRTHIPTARITSALAVFGSSSG

SEQ ID NO: 28376 - protein, 155 aa, Homo sapiens
  Payload ID: 5567
  Gene Symbol: ETV2
  Gene Name: ets variant 2
  ENSP ID: ENSP00000368309
MDLWNWDEASPQEVPPGNKLAGLEGAKLGFCFPDLALQGDTPTATAETCWKGPIQLWQFLLELLHDGARSSCIRWTGNSREFQLCDPKEVARLWGERKRKPGMNYEKLSRGLRYYYRRDIVRKSGGRKYTYRFGGRVPSLAYPDCAGGGRGAETQ

SEQ ID NO: 28377 - protein, 370 aa, Homo sapiens
  Payload ID: 5567
  Gene Symbol: ETV2
  Gene Name: ets variant 2
  Uniprot ID: O00321
  ENSP ID: ENSP00000368312
MDLWNWDEASPQEVPPGNKLAGLGRLPRLPQRVWGGCPGGASADPNPLSPAEGAKLGFCFPDLALQGDTPTATAETCWKGTSSSLASFPQLDWGSALLHPEVPWGAEPDSQALPWSGDWTDMACTAWDSWSGASQTLGPAPLGPGPIPAAGSEGAAGQNCVPVAGEATSWSRAQAAGSNTSWDCSVGPDGDTYWGSGLGGEPRTDCTISWGGPAGPDCTTSWNPGLHAGGTTSLKRYQSSALTVCSEPSPQSDRASLARCPKTNHRGPIQLWQFLLELLHDGARSSCIRWTGNSREFQLCDPKEVARLWGERKRKPGMNYEKLSRGLRYYYRRDIVRKSGGRKYTYRFGGRVPSLAYPDCAGGGRGAETQ

SEQ ID NO: 28378 - protein, 342 aa, Homo sapiens
  Payload ID: 5567
  Gene Symbol: ETV2
  Gene Name: ets variant 2
  Uniprot ID: O00321
  ENSP ID: ENSP00000384524
MDLWNWDEASPQEVPPGNKLAGLEGAKLGFCFPDLALQGDTPTATAETCWKGTSSSLASFPQLDWGSALLHPEVPWGAEPDSQALPWSGDWTDMACTAWDSWSGASQTLGPAPLGPGPIPAAGSEGAAGQNCVPVAGEATSWSRAQAAGSNTSWDCSVGPDGDTYWGSGLGGEPRTDCTISWGGPAGPDCTTSWNPGLHAGGTTSLKRYQSSALTVCSEPSPQSDRASLARCPKTNHRGPIQLWQFLLELLHDGARSSCIRWTGNSREFQLCDPKEVARLWGERKRKPGMNYEKLSRGLRYYYRRDIVRKSGGRKYTYRFGGRVPSLAYPDCAGGGRGAETQ

SEQ ID NO: 28379 - protein, 342 aa, Homo sapiens; identical to SEQ ID NO: 28378
  Payload ID: 5567
  Gene Symbol: ETV2
  Gene Name: ets variant 2
  Uniprot ID: O00321
  ENSP ID: ENSP00000385369

SEQ ID NO: 28380 - protein, 249 aa, Homo sapiens
  Payload ID: 5567
  Gene Symbol: ETV2
  Gene Name: ets variant 2
  ENSP ID: ENSP00000468453
MACTAWDSWSGASQTLGPAPLGPGPIPAAGSEGAAGQNCVPVAGEATSWSRAQAAGSNTSWDCSVGPDGDTYWGSGLGGEPRTDCTISWGGPAGPDCTTSWNPGLHAGGTTSLKRYQSSALTVCSEPSPQSDRASLARCPKTNHRGPIQLWQFLLELLHDGARSSCIRWTGNSREFQLCDPKEVARLWGERKRKPGMNYEKLSRGLRYYYRRDIVRKSGGRKYTYRFGGRVPSLAYPDCAGGGRGAETQ

SEQ ID NO: 28381 - protein, 95 aa, Homo sapiens
  Payload ID: 5567
  Gene Symbol: ETV2
  Gene Name: ets variant 2
  ENSP ID: ENSP00000475089
QSSALTVCSEPSPQSDRASLARCPKTNHRGPIQLWQFLLELLHDGARSSCIRWTGNSREFQLCDPKEVGQLPCPAKSAPSLLVQFSSAQGLGSTA

SEQ ID NO: 28382 - protein, 184 aa, Homo sapiens [sequence omitted]

SEQ ID NO: 28383 - protein, 184 aa, Homo sapiens [sequence omitted]

SEQ ID NO: 28384 - protein, 143 aa, Homo sapiens
  Payload ID: 5568
  Gene Symbol: ETV3
  Gene Name: ets variant 3
  Uniprot ID: P41162
  ENSP ID: ENSP00000327316
MKAGCSIVEKPEGGGGYQFPDWAYKTESSPGSRQIQLWHFILELLQKEEFRHVIAWQQGEYGEFVIKDPDEVARLWGRRKCKPQMNYDKLSRALRYYYNKRILHKTKGKRFTYKFNFNKLVMPNYPFINIRSSGKIQTLLVGN

SEQ ID NO: 28385 - protein, 512 aa, Homo sapiens
  Payload ID: 5568
  Gene Symbol: ETV3
  Gene Name: ets variant 3
  Uniprot ID: P41162
  ENSP ID: ENSP00000357175
MKAGCSIVEKPEGGGGYQFPDWAYKTESSPGSRQIQLWHFILELLQKEEFRHVIAWQQGEYGEFVIKDPDEVARLWGRRKCKPQMNYDKLSRALRYYYNKRILHKTKGKRFTYKFNFNKLVMPNYPFINIRSSGVVPQSAPPVPTASSRFHFPPLDTHSPTNDVQPGRFSASSLTASGQESSNGTDRKTELSELEDGSAADWRRGVDPVSSRNAIGGGGIGHQKRKPDIMLPLFARPGMYPDPHSPFAVSPIPGRGGVLNVPISPALSLTPTIFSYSPSPGLSPFTSSSCFSFNPEEMKHYLHSQACSVFNYHLSPRTFPRYPGLMVPPLQCQMHPEESTQFSIKLQPPPVGRKNRERVESSEESAPVTTPTMASIPPRIKVEPASEKDPESLRQSAREKEEHTQEEGTVPSRTIEEEKGTIFARPAAPPIWPSVPISTPSGEPLEVTEDSEDRPGKEPSAPEKKEDALMPPKLRLKRRWNDDPEARELSKSGKFLWNGSGPQGLATAAADA

SEQ ID NO: 28386 - protein, 361 aa, Homo sapiens
  Payload ID: 5569
  Gene Symbol: ETV3L
  Gene Name: ets variant 3-like
  Uniprot ID: Q6ZN32
  ENSP ID: ENSP00000430271
MHCSCLAEGIPANPGNWISGLAFPDWAYKAESSPGSRQIQLWHFILELLQKEEFRHVIAWQQGEYGEFVIKDPDEVARLWGRRKCKPQMNYDKLSRALRYYYNKRILHKTKGKRFTYKFNFSKLIVVNYPLWEVRAPPSPHLLLGAPALCRPALVPVGVQSELLHSMLFAHQAMVEQLTGQQTPRGPPETSGDKKGSSSSVYRLGSAPGPCRLGLCCHLGSVQGELPGVASFTPPLPPPLPSNWTCLSGPFLPPLPSEQQLPGAFKPDILLPGPRSLPGAWHFPGLPLLAGLGQGAGERLWLLSLRPEGLEVKPAPMMEAKGGLDPREVFCPETRRLKTGEESLTSPNLENLKAVWPLDPP

SEQ ID NO: 28387 - protein, 484 aa, Homo sapiens
  Payload ID: 5570
  Gene Symbol: ETV4
  Gene Name: ets variant 4
  Uniprot ID: P43268
  ENSP ID: ENSP00000321835
MERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 28388 - protein, 484 aa, Homo sapiens; identical to SEQ ID NO: 28387
  Payload ID: 5570
  Gene Symbol: ETV4
  Gene Name: ets variant 4
  Uniprot ID: P43268
  ENSP ID: ENSP00000377273

SEQ ID NO: 28389 - protein, 445 aa, Homo sapiens
  Payload ID: 5570
  Gene Symbol: ETV4
  Gene Name: ets variant 4
  Uniprot ID: P43268
  ENSP ID: ENSP00000440023
MDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 28390 - protein, 430 aa, Homo sapiens
  Payload ID: 5570
  Gene Symbol: ETV4
  Gene Name: ets variant 4
  ENSP ID: ENSP00000441749
MERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 28391 - protein, 445 aa, Homo sapiens; identical to SEQ ID NO: 28389
  Payload ID: 5570
  Gene Symbol: ETV4
  Gene Name: ets variant 4
  Uniprot ID: P43268
  ENSP ID: ENSP00000443846

SEQ ID NO: 28392 - protein, 484 aa, Homo sapiens; identical to SEQ ID NO: 28387
  Payload ID: 5570
  Gene Symbol: ETV4
  Gene Name: ets variant 4
  Uniprot ID: P43268
  ENSP ID: ENSP00000465718

SEQ ID NO: 28393 - protein, 28 aa, Homo sapiens
  Payload ID: 5570
  Gene Symbol: ETV4
  Gene Name: ets variant 4
  ENSP ID: ENSP00000466673
MDPGSLPPLDSEDLFQDLSHFQETWLAE

SEQ ID NO: 28394 - protein, 207 aa, Homo sapiens
  Payload ID: 5570
  Gene Symbol: ETV4
  Gene Name: ets variant 4
  Uniprot ID: P43268
  ENSP ID: ENSP00000468636
MYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 28395 - protein, 510 aa, Homo sapiens
  Payload ID: 5571
  Gene Symbol: ETV5
  Gene Name: ets variant 5
  Uniprot ID: P41161
  ENSP ID: ENSP00000306894
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 28396 - protein, 132 aa, Homo sapiens
  Payload ID: 5571
  Gene Symbol: ETV5
  Gene Name: ets variant 5
  ENSP ID: ENSP00000388737
MDGFYDQQVPFMVPGKSRSEECRGRPVIDRKRKFLDTDLAHDSEELFQDLSQLQEAWLAEAQVPDDEQFVPDFQSDNPFLFKLPQEFMIPFQFQFVAILYSPGSLSSFSKSAVQSGASCPTSNQDQTGAAQP

SEQ ID NO: 28397 - protein, 150 aa, Homo sapiens
  Payload ID: 5571
  Gene Symbol: ETV5
  Gene Name: ets variant 5
  ENSP ID: ENSP00000389707
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLF

SEQ ID NO: 28398 - protein, 89 aa, Homo sapiens
  Payload ID: 5571
  Gene Symbol: ETV5
  Gene Name: ets variant 5
  ENSP ID: ENSP00000399707
  MOD_RES (1)..(1): Any amino acid
XVPAAPPPPQGFKQEYHDPLYEHGVPGMPGPPAHGFQSPMGIKQEPRDYCVDSEVPNCQSSYMRGGYFSSSHEGCSALGHPEEPASHEL

SEQ ID NO: 28399 - protein, 132 aa, Homo sapiens
  Payload ID: 5571
  Gene Symbol: ETV5
  Gene Name: ets variant 5
  ENSP ID: ENSP00000405157
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFK

SEQ ID NO: 28400 - protein, 140 aa, Homo sapiens
  Payload ID: 5571
  Gene Symbol: ETV5
  Gene Name: ets variant 5
  ENSP ID: ENSP00000412171
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTP

SEQ ID NO: 28401 - protein, 510 aa, Homo sapiens; identical to SEQ ID NO: 28395
  Payload ID: 5571
  Gene Symbol: ETV5
  Gene Name: ets variant 5
  Uniprot ID: P41161
  ENSP ID: ENSP00000413755

SEQ ID NO: 28402 - protein, 50 aa, Homo sapiens
  Payload ID: 5572
  Gene Symbol: ETV6
  Gene Name: ets variant 6
  ENSP ID: ENSP00000266427
  MOD_RES (1)..(1): Any amino acid
XMTYEKMSRALRHYYKLNIIRKEPGQRLLFRFLFFLPRGSGLFLLLLGLG

SEQ ID NO: 28403 - protein, 452 aa, Homo sapiens
  Payload ID: 5572
  Gene Symbol: ETV6
  Gene Name: ets variant 6
  Uniprot ID: P41212
  ENSP ID: ENSP00000379658
MSETPAQCSIKQERISYTPPESPVPSYASSTPLHVPVPRALRMEEDSIRLPAHLRLQPIYWSRDDVAQWLKWAENEFSLRPIDSNTFEMNGKALLLLTKEDFRYRSPHSGDVLYELLQHILKQRKPRILFSPFFHPGNSIHTQPEVILHQNHEEDNCVQRTPRPSVDNVHHNPPTIELLHRSRSPITTNHRPSPDPEQRPLRSPLDNMIRRLSPAERAQGPRPHQENNHQESYPLSVSPMENNHCPASSESHPKPSSPRQESTRVIQLMPSPIMHPLILNPRHSVDFKQSRLSEDGLHREGKPINLSHREDLAYMNHIMVSVSPPEEHAMPIGRIADCRLLWDYVYQLLSDSRYENFIRWEDKESKIFRIVDPNGLARLWGNHKNRTNMTYEKMSRALRHYYKLNIIRKEPGQRLLFRFMKTPDEIMSGRTDRLEHLESQELDEQIYQEDEC

SEQ ID NO: 28404 - protein, 88 aa, Homo sapiens
  Payload ID: 5572
  Gene Symbol: ETV6
  Gene Name: ets variant 6
  ENSP ID: ENSP00000441463
SSTPLHVPVPRALRMEEDSIRLPAHLRLQPIYWSRDDVAQWLKWAENEFSLRPIDSNTFEMNGKALLLLTKEDFRYRSPHSDLDSDVT

SEQ ID NO: 28405 - protein, 341 aa, Homo sapiens
  Payload ID: 5573
  Gene Symbol: ETV7
  Gene Name: ets variant 7
  Uniprot ID: Q9Y603
  ENSP ID: ENSP00000341843
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 28406 - protein, 317 aa, Homo sapiens
  Payload ID: 5573
  Gene Symbol: ETV7
  Gene Name: ets variant 7
  Uniprot ID: Q9Y603
  ENSP ID: ENSP00000342260
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRNGLQLIFIFIWSFQ

SEQ ID NO: 28407 - protein, 264 aa, Homo sapiens
  Payload ID: 5573
  Gene Symbol: ETV7
  Gene Name: ets variant 7
  Uniprot ID: Q9Y603
  ENSP ID: ENSP00000362842
MQEGELAISPISPVAAMPPLGTHVQARCEAQINLLGEGGICKLPGRLRIQPALWSREDVLHWLRWAEQEYSLPCTAEHGFEMNGRALCILTKDDFRHRAPSSGDVLYELLQYIKTQRRALVCGPFFGGIFRLKTPTQHSPVPPEDCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 28408 - protein, 286 aa, Homo sapiens
  Payload ID: 5573
  Gene Symbol: ETV7
  Gene Name: ets variant 7
  Uniprot ID: Q9Y603
  ENSP ID: ENSP00000362843
MQEGELAISPISPVAAMPPLGTHVQARCEAQINLLGEGGICKLPGRLRDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 28409 - protein, 190 aa, Homo sapiens
  Payload ID: 5573
  Gene Symbol: ETV7
  Gene Name: ets variant 7
  Uniprot ID: Q9Y603
  ENSP ID: ENSP00000440592
MDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 28410 - protein, 282 aa, Homo sapiens
  Payload ID: 5573
  Gene Symbol: ETV7
  Gene Name: ets variant 7
  Uniprot ID: Q9Y603
  ENSP ID: ENSP00000481885
MHRGARVRDERTRPLHPHQGRLPAPCAQLRSGKRTGFPLSGNPGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 28411 - protein, 260 aa, Homo sapiens
  Payload ID: 5573
  Gene Symbol: ETV7
  Gene Name: ets variant 7
  Uniprot ID: Q9Y603
  ENSP ID: ENSP00000484485
MNGRALCILTKDDFRHRAPSSGDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRFLKTPGKMVQDKHSHLEPLESQEQDRIEFKDKRPEISP

SEQ ID NO: 28412 - protein, 262 aa, Homo sapiens
  Payload ID: 5573
  Gene Symbol: ETV7
  Gene Name: ets variant 7
  Uniprot ID: Q9Y603
  ENSP ID: ENSP00000486712
MQEGELAISPISPVAAMPPLGTHVQARCEAQINLLGEGGICKLPGRLRDVLYELLQYIKTQRRALVCGPFFGGIFRLKTPTQHSPVPPEEVTGPSQMDTRRGHLLQPPDPGLTSNFGHLDDPGLARWTPGKEESLNLCHCAELGCRTQGVCSFPAMPQAPIDGRIADCRLLWDYVYQLLLDTRYEPYIKWEDKDAKIFRVVDPNGLARLWGNHKNRVNMTYEKMSRALRHYYKLNIIKKEPGQKLLFRNGLQLIFIFIWSFQ

SEQ ID NO: 28413 - protein, 548 aa, Homo sapiens
  Payload ID: 5574
  Gene Symbol: ERF
  Gene Name: Ets2 repressor factor
  Uniprot ID: P50548
  ENSP ID: ENSP00000222329
MKTPADTGFAFPDWAYKPESSPGSRQIQLWHFILELLRKEEYQGVIAWQGDYGEFVIKDPDEVARLWGVRKCKPQMNYDKLSRALRYYYNKRILHKTKGKRFTYKFNFNKLVLVNYPFIDVGLAGGAVPQSAPPVPSGGSHFRFPPSTPSEVLSPTEDPRSPPACSSSSSSLFSAVVARRLGRGSVSDCSDGTSELEEPLGEDPRARPPGPPDLGAFRGPPLARLPHDPGVFRVYPRPRGGPEPLSPFPVSPLAGPGSLLPPQLSPALPMTPTHLAYTPSPTLSPMYPSGGGGPSGSGGGSHFSFSPEDMKRYLQAHTQSVYNYHLSPRAFLHYPGLVVPQPQRPDKCPLPPMAPETPPVPSSASSSSSSSSSPFKFKLQPPPLGRRQRAAGEKAVAGADKSGGSAGGLAEGAGALAPPPPPPQIKVEPISEGESEEVEVTDISDEDEEDGEVFKTPRAPPAPPKPEPGEAPGASQCMPLKLRFKRRWSEDCRLEGGGGPAGGFEDEGEDKKVRGEGPGEAGGPLTPRRVSSDLQHATAQLSLEHRDS

SEQ ID NO: 28414 - protein, 473 aa, Homo sapiens
  Payload ID: 5574
  Gene Symbol: ERF
  Gene Name: Ets2 repressor factor
  Uniprot ID: P50548
  ENSP ID: ENSP00000388173
MNYDKLSRALRYYYNKRILHKTKGKRFTYKFNFNKLVLVNYPFIDVGLAGGAVPQSAPPVPSGGSHFRFPPSTPSEVLSPTEDPRSPPACSSSSSSLFSAVVARRLGRGSVSDCSDGTSELEEPLGEDPRARPPGPPDLGAFRGPPLARLPHDPGVFRVYPRPRGGPEPLSPFPVSPLAGPGSLLPPQLSPALPMTPTHLAYTPSPTLSPMYPSGGGGPSGSGGGSHFSFSPEDMKRYLQAHTQSVYNYHLSPRAFLHYPGLVVPQPQRPDKCPLPPMAPETPPVPSSASSSSSSSSSPFKFKLQPPPLGRRQRAAGEKAVAGADKSGGSAGGLAEGAGALAPPPPPPQIKVEPISEGESEEVEVTDISDEDEEDGEVFKTPRAPPAPPKPEPGEAPGASQCMPLKLRFKRRWSEDCRLEGGGGPAGGFEDEGEDKKVRGEGPGEAGGPLTPRRVSSDLQHATAQLSLEHRDS

SEQ ID NO: 28415 - protein, 61 aa, Homo sapiens
  Payload ID: 5574
  Gene Symbol: ERF
  Gene Name: Ets2 repressor factor
  ENSP ID: ENSP00000468962
MNYDKLSRALRYYYNKRILHKTKGKRFTYKFNFNKLVLVNYPFIDVGLAGAVPHRGPPLTT

SEQ ID NO: 28416 - protein, 98 aa, Homo sapiens
  Payload ID: 5574
  Gene Symbol: ERF
  Gene Name: Ets2 repressor factor
  ENSP ID: ENSP00000469274
MNYDKLSRALRYYYNKRILHKTKGKRFTYKFNFNKLVLVNYPFIDVGLAGGAVPQSAPPVPSGGSHFRFPPSTPSEVLSPTEDPRSPPACSSSSSSLF

SEQ ID NO: 28417 - protein, 808 aa, Homo sapiens
  Payload ID: 5575
  Gene Symbol: EHMT1
  Gene Name: euchromatic histone-lysine N-methyltransferase 1
  Uniprot ID: Q9H9B1
  ENSP ID: ENSP00000417328
MAAADAEAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQFCRLGSPRSRGCLW

SEQ ID NO: 28418 - protein, 1298 aa, Homo sapiens
  Payload ID: 5575
  Gene Symbol: EHMT1
  Gene Name: euchromatic histone-lysine N-methyltransferase 1
  Uniprot ID: Q9H9B1
  ENSP ID: ENSP00000417980
MAAADAEAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAALAQRQASAAQEAQEDGLPDTSSAAAADPL

SEQ ID NO: 28419 - protein, 803 aa, Homo sapiens
  Payload ID: 5575
  Gene Symbol: EHMT1
  Gene Name: euchromatic histone-lysine N-methyltransferase 1
  ENSP ID: ENSP00000436107
MSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSA

SEQ ID NO: 28420 - protein, 106 aa, Homo sapiens
  Payload ID: 5575
  Gene Symbol: EHMT1
  Gene Name: euchromatic histone-lysine N-methyltransferase 1
  ENSP ID: ENSP00000485878
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPL

SEQ ID NO: 28421 - protein, 432 aa, Homo sapiens
  Payload ID: 5575
  Gene Symbol: EHMT1
  Gene Name: euchromatic histone-lysine N-methyltransferase 1
  ENSP ID: ENSP00000485900
  MOD_RES (1)..(1): Any amino acid
XGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSS

SEQ ID NO: 28422 - protein, 137 aa, Homo sapiens
  Payload ID: 5575
  Gene Symbol: EHMT1
  Gene Name: euchromatic histone-lysine N-methyltransferase 1
  ENSP ID: ENSP00000485933
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAF

SEQ ID NO: 28423 - protein, 66 aa, Homo sapiens
  Payload ID: 5575
  Gene Symbol: EHMT1
  Gene Name: euchromatic histone-lysine N-methyltransferase 1
  Uniprot ID: Q9H9B1
  ENSP ID: ENSP00000485945
MAAADAERHLWLPMKAQQRNRQERPTWLRTVRPMGLVKTAMPAVMQMLQSTLRTAQGSTPRMAPTH

SEQ ID NO: 28424 - protein, 230 aa, Homo sapiens
  Payload ID: 5575
  Gene Symbol: EHMT1
  Gene Name: euchromatic histone-lysine N-methyltransferase 1
  ENSP ID: ENSP00000485947
  MOD_RES (1)..(1): Any amino acid
XPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREI

SEQ ID NO: 28425 - protein, 108 aa, Homo sapiens
  Payload ID: 5575
  Gene Symbol: EHMT1
  Gene Name: euchromatic histone-lysine N-methyltransferase 1
  ENSP ID: ENSP00000486127
  MOD_RES (1)..(1): Any amino acid
XPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNVGCIYSKYTLG

SEQ ID NO: 28426 - protein, 167 aa, Homo sapiens
  Payload ID: 5575
  Gene Symbol: EHMT1
  Gene Name: euchromatic histone-lysine N-methyltransferase 1
  ENSP ID: ENSP00000486261
WIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHEGNFMECQPESSISHRFHKDCASRVNNASYCPHCGEESSKAKEVTIAKADTTSTV

SEQ ID NO: 28427 - protein, 107 aa, Homo sapiens
  Payload ID: 5575
  Gene Symbol: EHMT1
  Gene Name: euchromatic histone-lysine N-methyltransferase 1
  ENSP ID: ENSP00000486503
MEAAENNHLEAVKYLIKAGALVDPKDAEGSTCLHLAAKKGHYEVVQYLLSNGQMDVNCQDDGGWTPMIWATEYKHVDLVKLLLSKGSDINIRDNRVPEARNGKSSHK

SEQ ID NO: 28428 - protein, 139 aa, Homo sapiens
  Payload ID: 5575
  Gene Symbol: EHMT1
  Gene Name: euchromatic histone-lysine N-methyltransferase 1
  ENSP ID: ENSP00000486580
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQ

SEQ ID NO: 28429 - protein, 117 aa, Homo sapiens
  Payload ID: 5575
  Gene Symbol: EHMT1
  Gene Name: euchromatic histone-lysine N-methyltransferase 1
  ENSP ID: ENSP00000486748
MEAAENNHLEAVKYLIKAGALVDPKDAEGSTCLHLAAKKGHYEVVQYLLSNGQMDVNCQDDGGWTPMIWATEYKHVDLVKLLLSKGSDINIRDNDDGTMKRGALSRQKEEKREAEEP

SEQ ID NO: 28430 - protein, 134 aa, Homo sapiens
  Payload ID: 5575
  Gene Symbol: EHMT1
  Gene Name: euchromatic histone-lysine N-methyltransferase 1
  ENSP ID: ENSP00000486857
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTP

SEQ ID NO: 28431 - protein, 268 aa, Homo sapiens
  Payload ID: 5575
  Gene Symbol: EHMT1
  Gene Name: euchromatic histone-lysine N-methyltransferase 1
  ENSP ID: ENSP00000486969
MLYFSRSHFPRPCGGQVSAGSGLTLLLLLLPALWRGWLEGDGQQAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHK

SEQ ID NO: 28432 - protein, 1233 aa, Homo sapiens
  Payload ID: 5576
  Gene Symbol: EHMT2
  Gene Name: euchromatic histone-lysine N-methyltransferase 2
  ENSP ID: ENSP00000364678
MRGLPRGRGLMRARGRGRAAPPGSRGRGRGGPHRGRGRPRSLLSLPRAQASWTPQLSTGLTSPPVPCLPSQGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 28433 - protein, 1176 aa, Homo sapiens
  Payload ID: 5576
  Gene Symbol: EHMT2
  Gene Name: euchromatic histone-lysine N-methyltransferase 2
  Uniprot ID: Q96KQ7
  ENSP ID: ENSP00000364680
MAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 28434 - protein, 1210 aa, Homo sapiens
  Payload ID: 5576
  Gene Symbol: EHMT2
  Gene Name: euchromatic histone-lysine N-methyltransferase 2
  Uniprot ID: Q96KQ7
  ENSP ID: ENSP00000364687
MAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 28435 - protein, 1176 aa, Homo sapiens; identical to SEQ ID NO: 28433
  Payload ID: 5576
  Gene Symbol: EHMT2
  Gene Name: euchromatic histone-lysine N-methyltransferase 2
  Uniprot ID: Q96KQ7
  ENSP ID: ENSP00000372863

SEQ ID NO: 28436 - protein, 1210 aa, Homo sapiens; identical to SEQ ID NO: 28434
  Payload ID: 5576
  Gene Symbol: EHMT2
  Gene Name: euchromatic histone-lysine N-methyltransferase 2
  Uniprot ID: Q96KQ7
  ENSP ID: ENSP00000372864

SEQ ID NO: 28437 - protein, 1267 aa, Homo sapiens
  Payload ID: 5576
  Gene Symbol: EHMT2
  Gene Name: euchromatic histone-lysine N-methyltransferase 2
  ENSP ID: ENSP00000379078
MRGLPRGRGLMRARGRGRAAPPGSRGRGRGGPHRGRGRPRSLLSLPRAQASWTPQLSTGLTSPPVPCLPSQGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 28438 - protein, 1267 aa, Homo sapiens; identical to SEQ ID NO: 28437
  Payload ID: 5576
  Gene Symbol: EHMT2
  Gene Name: euchromatic histone-lysine N-methyltransferase 2
  ENSP ID: ENSP00000382886

SEQ ID NO: 28439 - protein, 1233 aa, Homo sapiens; identical to SEQ ID NO: 28432
  Payload ID: 5576
  Gene Symbol: EHMT2
  Gene Name: euchromatic histone-lysine N-methyltransferase 2
  ENSP ID: ENSP00000382888

SEQ ID NO: 28440 - protein, 1233 aa, Homo sapiens
  Payload ID: 5576
  Gene Symbol: EHMT2
  Gene Name: euchromatic histone-lysine N-methyltransferase 2
  ENSP ID: ENSP00000388879
MRGLPRGRGLMRARGRGRAAPPGSRGRGRGGPHRGRGRPRSLLSLPRAQASWTPQLSTGLTSPPVPCLPSQGEAPAEMGALLLEKETRGATERVHGSLGDTPRSEETLPKANPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 28441 - protein, 1210 aa, Homo sapiens; identical to SEQ ID NO: 28434
  Payload ID: 5576
  Gene Symbol: EHMT2
  Gene Name: euchromatic histone-lysine N-methyltransferase 2
  Uniprot ID: Q96KQ7
  ENSP ID: ENSP00000392305

SEQ ID NO: 28442 - protein, 298 aa, Homo sapiens
  Payload ID: 5576
  Gene Symbol: EHMT2
  Gene Name: euchromatic histone-lysine N-methyltransferase 2
  ENSP ID: ENSP00000392520
  MOD_RES (1)..(1): Any amino acid
XSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQGQLPPPSLPSHPQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRN

SEQ ID NO: 28443 - protein, 298 aa, Homo sapiens; identical to SEQ ID NO: 28442
  Payload ID: 5576
  Gene Symbol: EHMT2
  Gene Name: euchromatic histone-lysine N-methyltransferase 2
  ENSP ID: ENSP00000392729
  MOD_RES (1)..(1): Any amino acid

SEQ ID NO: 28444 - protein, 1210 aa, Homo sapiens
  Payload ID: 5576
  Gene Symbol: EHMT2
  Gene Name: euchromatic histone-lysine N-methyltransferase 2
  Uniprot ID: Q96KQ7
  ENSP ID: ENSP00000396119
MAAAAGAAAAAAAEGEAPAEMGALLLEKETRGATERVHGSLGDTPRSEETLPKANPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 28445 - protein, 1267 aa, Homo sapiens; identical to SEQ ID NO: 28437
  Payload ID: 5576
  Gene Symbol: EHMT2
  Gene Name: euchromatic histone-lysine N-methyltransferase 2
  ENSP ID: ENSP00000397323

SEQ ID NO: 28446 - protein, 1267 aa, Homo sapiens; identical to SEQ ID NO: 28437
  Payload ID: 5576
  Gene Symbol: EHMT2
  Gene Name: euchromatic histone-lysine N-methyltransferase 2
  ENSP ID: ENSP00000398286

SEQ ID NO: 28447 - protein, 922 aa, Homo sapiens
  Payload ID: 5576
  Gene Symbol: EHMT2
  Gene Name: euchromatic histone-lysine N-methyltransferase 2
  ENSP ID: ENSP00000399135
SEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 28448 - protein, 1176 aa, Homo sapiens
  Payload ID: 5576
  Gene Symbol: EHMT2
  Gene Name: euchromatic histone-lysine N-methyltransferase 2
  ENSP ID: ENSP00000399344
MAAAAGAAAAAAAEGEAPAEMGALLLEKETRGATERVHGSLGDTPRSEETLPKANPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 28449 - protein, 1176 aa, Homo sapiens; identical to SEQ ID NO: 28433
  Payload ID: 5576
  Gene Symbol: EHMT2
  Gene Name: euchromatic histone-lysine N-methyltransferase 2
  Uniprot ID: Q96KQ7
  ENSP ID: ENSP00000400838

SEQ ID NO: 28450 - protein, 1233 aa, Homo sapiens; identical to SEQ ID NO: 28432
  Payload ID: 5576
  Gene Symbol: EHMT2
  Gene Name: euchromatic histone-lysine N-methyltransferase 2
  ENSP ID: ENSP00000400861

SEQ ID NO: 28451 - protein, 1233 aa, Homo sapiens; identical to SEQ ID NO: 28440
  Payload ID: 5576
  Gene Symbol: EHMT2
  Gene Name: euchromatic histone-lysine N-methyltransferase 2
  ENSP ID: ENSP00000401012

SEQ ID NO: 28452 - protein, 1176 aa, Homo sapiens; identical to SEQ ID NO: 28448
  Payload ID: 5576
  Gene Symbol: EHMT2
  Gene Name: euchromatic histone-lysine N-methyltransferase 2
  ENSP ID: ENSP00000401424

SEQ ID NO: 28453 - protein, 298 aa, Homo sapiens; identical to SEQ ID NO: 28442
  Payload ID: 5576
  Gene Symbol: EHMT2
  Gene Name: euchromatic histone-lysine N-methyltransferase 2
  ENSP ID: ENSP00000401428
  MOD_RES (1)..(1): Any amino acid

SEQ ID NO: 28454 - protein, 298 aa, Homo sapiens; identical to SEQ ID NO: 28442
  Payload ID: 5576
  Gene Symbol: EHMT2
  Gene Name: euchromatic histone-lysine N-methyltransferase 2
  ENSP ID: ENSP00000401785
  MOD_RES (1)..(1): Any amino acid

SEQ ID NO: 28455 - protein, 1233 aa, Homo sapiens; identical to SEQ ID NO: 28432
  Payload ID: 5576
  Gene Symbol: EHMT2
  Gene Name: euchromatic histone-lysine N-methyltransferase 2
  ENSP ID: ENSP00000403402

SEQ ID NO: 28456 - protein, 1210 aa, Homo sapiens; identical to SEQ ID NO: 28434
  Payload ID: 5576
  Gene Symbol: EHMT2
  Gene Name: euchromatic histone-lysine N-methyltransferase 2
  Uniprot ID: Q96KQ7
  ENSP ID: ENSP00000406110

SEQ ID NO: 28457 - protein, 298 aa, Homo sapiens; identical to SEQ ID NO: 28442
  Payload ID: 5576
  Gene Symbol: EHMT2
  Gene Name: euchromatic histone-lysine N-methyltransferase 2
  ENSP ID: ENSP00000408266
  MOD_RES (1)..(1): Any amino acid

SEQ ID NO: 28458 - protein, 1267 aa, Homo sapiens
  Payload ID: 5576
  Gene Symbol: EHMT2
  Gene Name: euchromatic histone-lysine N-methyltransferase 2
  ENSP ID: ENSP00000408583
MRGLPRGRGLMRARGRGRAAPPGSRGRGRGGPHRGRGRPRSLLSLPRAQASWTPQLSTGLTSPPVPCLPSQGEAPAEMGALLLEKETRGATERVHGSLGDTPRSEETLPKANPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 28459 - protein, 1176 aa, Homo sapiens; identical to SEQ ID NO: 28433
  Payload ID: 5576
  Gene Symbol: EHMT2
  Gene Name: euchromatic histone-lysine N-methyltransferase 2
  Uniprot ID: Q96KQ7
  ENSP ID: ENSP00000411035

SEQ ID NO: 28460 - protein, 298 aa, Homo sapiens; identical to SEQ ID NO: 28442
  Payload ID: 5576
  Gene Symbol: EHMT2
  Gene Name: euchromatic histone-lysine N-methyltransferase 2
  ENSP ID: ENSP00000412353
  MOD_RES (1)..(1): Any amino acid

SEQ ID NO: 28461 - protein, 888 aa, Homo sapiens
  Payload ID: 5576
  Gene Symbol: EHMT2
  Gene Name: euchromatic histone-lysine N-methyltransferase 2
  ENSP ID: ENSP00000413358
SEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 28462 - protein, 1267 aa, Homo sapiens; identical to SEQ ID NO: 28458
  Payload ID: 5576
  Gene Symbol: EHMT2
  Gene Name: euchromatic histone-lysine N-methyltransferase 2
  ENSP ID: ENSP00000414377

SEQ ID NO: 28463 - protein, 298 aa, Homo sapiens; identical to SEQ ID NO: 28442
  Payload ID: 5576
  Gene Symbol: EHMT2
  Gene Name: euchromatic histone-lysine N-methyltransferase 2
  ENSP ID: ENSP00000416771
  MOD_RES (1)..(1): Any amino acid

SEQ ID NO: 28464 - protein, 1210 aa, Homo sapiens; identical to SEQ ID NO: 28444
  Payload ID: 5576
  Gene Symbol: EHMT2
  Gene Name: euchromatic histone-lysine N-methyltransferase 2
  Uniprot ID: Q96KQ7
  ENSP ID: ENSP00000416957

SEQ ID NO: 28465 - protein, 922 aa, Homo sapiens; identical to SEQ ID NO: 28447
  Payload ID: 5576
  Gene Symbol: EHMT2
  Gene Name: euchromatic histone-lysine N-methyltransferase 2
  ENSP ID: ENSP00000486948

SEQ ID NO: 28466 - protein, 888 aa, Homo sapiens; identical to SEQ ID NO: 28461
  Payload ID: 5576
  Gene Symbol: EHMT2
  Gene Name: euchromatic histone-lysine N-methyltransferase 2
  ENSP ID: ENSP00000486997

SEQ ID NO: 28467 - protein, 725 aa, Homo sapiens
  Payload ID: 5577
  Gene Symbol: EEF2K
  Gene Name: eukaryotic elongation factor 2 kinase
  Uniprot ID: O00418
  ENSP ID: ENSP00000263026
MADEDLIFRLEGVDGGQSPRAGHDGDSDGDSDDEEGYFICPITDDPSSNQNVNSKVNKYYSNLTKSERYSSSGSPANSFHFKEAWKHAIQKAKHMPDPWAEFHLEDIATERATRHRYNAVTGEWLDDEVLIKMASQPFGRGAMRECFRTKKLSNFLHAQQWKGASNYVAKRYIEPVDRDVYFEDVRLQMEAKLWGEEYNRHKPPKQVDIMQMCIIELKDRPGKPLFHLEHYIEGKYIKYNSNSGFVRDDNIRLTPQAFSHFTFERSGHQLIVVDIQGVGDLYTDPQIHTETGTDFGDGNLGVRGMALFFYSHACNRICESMGLAPFDLSPRERDAVNQNTKLLQSAKTILRGTEEKCGSPQVRTLSGSRPPLLRPLSENSGDENMSDVTFDSLPSSPSSATPHSQKLDHLHWPVFSDLDNMASRDHDHLDNHRESENSGDSGYPSEKRGELDDPEPREHGHSYSNRKYESDEDSLGSSGRVCVEKWNLLNSSRLHLPRASAVALEVQRLNALDLEKKIGKSILGKVHLAMVRYHEGGRFCEKGEEWDQESAVFHLEHAANLGELEAIVGLGLMYSQLPHHILADVSLKETEENKTKGFDYLLKAAEAGDRQSMILVARAFDSGQNLSPDRCQDWLEALHWYNTALEMTDCDEGGEYDGMQDEPRYMMLAREAEMLFTGGYGLEKDPQRSGDLYTQAAEAAMEAMKGRLANQYYQKAEEAWAQMEE

SEQ ID NO: 28468 - protein, 412 aa, Homo sapiens
  Payload ID: 5577
  Gene Symbol: EEF2K
  Gene Name: eukaryotic elongation factor 2 kinase
  ENSP ID: ENSP00000456243
MADEDLIFRLEGVDGGQSPRAGHDGDSDGDSDDEEGYFICPITDDPSSNQNVNSKVNKYYSNLTKSERYSSSGSPANSFHFKEAWKHAIQKAKHMPDPWAEFHLEDIATERATRHRYNAVTGEWLDDEVLIKMASQPFGRGAMRECFRTKKLSNFLHAQQWKGASNYVAKRYIEPVDRDVYFEDVRLQMEAKLWGEEYNRHKPPKQVDIMQMCIIELKDRPGKPLFHLEHYIEGKYIKYNSNSGFVRDDNIRLTPQAFSHFTFERSGHQLIVVDIQGVGDLYTDPQIHTETGTDFGDGNLGVRGMALFFYSHACNRICESMGLAPFDLSPRERDAVNQNTKLLQSAKTILRGTEEKCGSPQVRTLSGSRPPLLRPLSENSGDENMSDVTFDSLPSSPSSATPHSQKLDHLRE

SEQ ID NO: 28469 - protein, 296 aa, Homo sapiens
  Payload ID: 5578
  Gene Symbol: EEF2KMT
  Gene Name: eukaryotic elongation factor 2 lysine methyltransferase
  Uniprot ID: Q96G04
  ENSP ID: ENSP00000389710
MAPEENAGTELLLQSFERRFLAARTLRSFPWQSLEAKLRDSSDSELLRDILHKTVKHPVCVKHPPSVKYARCFLSELIKKPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 28470 - protein, 330 aa, Homo sapiens
  Payload ID: 5578
  Gene Symbol: EEF2KMT
  Gene Name: eukaryotic elongation factor 2 lysine methyltransferase
  Uniprot ID: Q96G04
  ENSP ID: ENSP00000398502
MAPEENAGTELLLQSFERRFLAARTLRSFPWQSLEAKLRDSSDSELLRDILHKTVKHPVCVKHPPSVKYARCFLSELIKKHEAVHTEPLDELYEALAETLMAKESTQGHRSYLLPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 28471 - protein, 58 aa, Homo sapiens
  Payload ID: 5578
  Gene Symbol: EEF2KMT
  Gene Name: eukaryotic elongation factor 2 lysine methyltransferase
  ENSP ID: ENSP00000464773
MAPEENAGTELLLQSFERRFLAARTLRSFPWQAVIVLVTGTQLPSPILKSQRRQDRRA

SEQ ID NO: 28472 - protein, 73 aa, Homo sapiens
  Payload ID: 5578
  Gene Symbol: EEF2KMT
  Gene Name: eukaryotic elongation factor 2 lysine methyltransferase
  ENSP ID: ENSP00000464781
MAPEENAGTELLLQSFERRFLAARTLRSFPWQSLEAKLRDSSDSELLRDILHKVRIPESLGLMTLPPESLQKT

SEQ ID NO: 28473 - protein, 73 aa, Homo sapiens; identical to SEQ ID NO: 28472
  Payload ID: 5578
  Gene Symbol: EEF2KMT
  Gene Name: eukaryotic elongation factor 2 lysine methyltransferase
  ENSP ID: ENSP00000467790

SEQ ID NO: 28474 - protein, 269 aa, Homo sapiens
  Payload ID: 5578
  Gene Symbol: EEF2KMT
  Gene Name: eukaryotic elongation factor 2 lysine methyltransferase
  ENSP ID: ENSP00000468599
MAPEENAGTELLLQSFERRFLAARTLRSFPWQSLEAKLRDSSDSELLRDILHKPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 28475 - protein, 596 aa, Homo sapiens
  Payload ID: 5579
  Gene Symbol: EEFSEC
  Gene Name: eukaryotic elongation factor, selenocysteine-tRNA-specific
  Uniprot ID: P57772
  ENSP ID: ENSP00000254730
MAGRRVNVNVGVLGHIDSGKTALARALSTTASTAAFDKQPQSRERGITLDLGFSCFSVPLPARLRSSLPEFQAAPEAEPEPGEPLLQVTLVDCPGHASLIRTIIGGAQIIDLMMLVIDVTKGMQTQSAECLVIGQIACQKLVVVLNKIDLLPEGKRQAAIDKMTKKMQKTLENTKFRGAPIIPVAAKPGGPEAPETEAPQGIPELIELLTSQISIPTRDPSGPFLMSVDHCFSIKGQGTVMTGTILSGSISLGDSVEIPALKVVKKVKSMQMFHMPITSAMQGDRLGICVTQFDPKLLERGLVCAPESLHTVHAALISVEKIPYFRGPLQTKAKFHITVGHETVMGRLMFFSPAPDNFDQEPILDSFNFSQEYLFQEQYLSKDLTPAVTDNDEADKKAGQATEGHCPRQQWALVEFEKPVTCPRLCLVIGSRLDADIHTNTCRLAFHGILLHGLEDRNYADSFLPRLKVYKLKHKHGLVERAMDDYSVIGRSLFKKETNIQLFVGLKVHLSTGELGIIDSAFGQSGKFKIHIPGGLSPESKKILTPALKKRARAGRGEATRQEESAERSEPSQHVVLSLTFKRYVFDTHKRMVQSP

SEQ ID NO: 28476 - protein, 436 aa, Homo sapiens
  Payload ID: 5579
  Gene Symbol: EEFSEC
  Gene Name: eukaryotic elongation factor, selenocysteine-tRNA-specific
  ENSP ID: ENSP00000417660
MAGRRVNVNVGVLGHIDSGKTALARALSTTASTAAFDKQPQSRERGITLDLGFSCFSVPLPARLRSSLPEFQAAPEAEPEPGEPLLQVTLVDCPGHASLIRTIIGGAQIIDLMMLVIDVTKGMQTQSAECLVIGQIACQKLVVVLNKIDLLPEGKRQAAIDKMTKKMQKTLENTKFRGAPIIPVAAKPGGPEAPETEAPQGIPELIEVVKKVKSMQMFHMPITSAMQGDRLGICVTQFDPKLLERGLVCAPESLHTVHAALISVEKIPYFRGPLQTKAKFHITVGHETVMGRLMFFSPAPDNFDQEPILDSFNFSQEYLFQEQYLSKDLTPAVTDNDEADKKAGQATEGHCPRQQWALVEFEKPVTCPRLCLVIGSRLDADIHTNTCRLAFHGILLHGLEDRNYADSFLPRLKVYKLKHKHGLVERVASAPSPRRS

SEQ ID NO: 28477 - protein, 462 aa, Homo sapiens
  Payload ID: 5580
  Gene Symbol: EEF1A1
  Gene Name: eukaryotic translation elongation factor 1 alpha 1
  Uniprot ID: P68104
  ENSP ID: ENSP00000330054
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 28478 - protein, 462 aa, Homo sapiens; identical to SEQ ID NO: 28477
  Payload ID: 5580
  Gene Symbol: EEF1A1
  Gene Name: eukaryotic translation elongation factor 1 alpha 1
  Uniprot ID: P68104
  ENSP ID: ENSP00000339053

SEQ ID NO: 28479 - protein, 462 aa, Homo sapiens; identical to SEQ ID NO: 28477
  Payload ID: 5580
  Gene Symbol: EEF1A1
  Gene Name: eukaryotic translation elongation factor 1 alpha 1
  Uniprot ID: P68104
  ENSP ID: ENSP00000339063

SEQ ID NO: 28480 - protein, 145 aa, Homo sapiens
  Payload ID: 5580
  Gene Symbol: EEF1A1
  Gene Name: eukaryotic translation elongation factor 1 alpha 1
  ENSP ID: ENSP00000348651
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGV

SEQ ID NO: 28481 - protein, 106 aa, Homo sapiens
  Payload ID: 5580
  Gene Symbol: EEF1A1
  Gene Name: eukaryotic translation elongation factor 1 alpha 1
  ENSP ID: ENSP00000392366
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGT

SEQ ID NO: 28482 - protein, 426 aa, Homo sapiens
  Payload ID: 5580
  Gene Symbol: EEF1A1
  Gene Name: eukaryotic translation elongation factor 1 alpha 1
  ENSP ID: ENSP00000479055
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVPSGDWCSPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGKSLCCS

SEQ ID NO: 28483 - protein, 441 aa, Homo sapiens
  Payload ID: 5580
  Gene Symbol: EEF1A1
  Gene Name: eukaryotic translation elongation factor 1 alpha 1
  ENSP ID: ENSP00000479609
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 28484 - protein, 463 aa, Homo sapiens
  Payload ID: 5581
  Gene Symbol: EEF1A2
  Gene Name: eukaryotic translation elongation factor 1 alpha 2
  Uniprot ID: Q05639
  ENSP ID: ENSP00000217182
MGKEKTHINIVVIGHVDSGKSTTTGHLIYKCGGIDKRTIEKFEKEAAEMGKGSFKYAWVLDKLKAERERGITIDISLWKFETTKYYITIIDAPGHRDFIKNMITGTSQADCAVLIVAAGVGEFEAGISKNGQTREHALLAYTLGVKQLIVGVNKMDSTEPAYSEKRYDEIVKEVSAYIKKIGYNPATVPFVPISGWHGDNMLEPSPNMPWFKGWKVERKEGNASGVSLLEALDTILPPTRPTDKPLRLPLQDVYKIGGIGTVPVGRVETGILRPGMVVTFAPVNITTEVKSVEMHHEALSEALPGDNVGFNVKNVSVKDIRRGNVCGDSKSDPPQEAAQFTSQVIILNHPGQISAGYSPVIDCHTAHIACKFAELKEKIDRRSGKKLEDNPKSLKSGDAAIVEMVPGKPMCVESFSQYPPLGRFAVRDMRQTVAVGVIKNVEKKSGGAGKVTKSAQKAQKAGK

SEQ ID NO: 28485 - protein, 463 aa, Homo sapiens; identical to SEQ ID NO: 28484
  Payload ID: 5581
  Gene Symbol: EEF1A2
  Gene Name: eukaryotic translation elongation factor 1 alpha 2
  Uniprot ID: Q05639
  ENSP ID: ENSP00000298049

SEQ ID NO: 28486 - protein, 225 aa, Homo sapiens
  Payload ID: 5582
  Gene Symbol: EEF1B2
  Gene Name: eukaryotic translation elongation factor 1 beta 2
  Uniprot ID: P24534
  ENSP ID: ENSP00000236957
MGFGDLKSPAGLQVLNDYLADKSYIEGYVPSQADVAVFEAVSSPPPADLCHALRWYNHIKSYEKEKASLPGVKKALGKYGPADVEDTTGSGATDSKDDDDIDLFGSDDEEESEEAKRLREERLAQYESKKAKKPALVAKSSILLDVKPWDDETDMAKLEECVRSIQADGLVWGSSKLVPVGYGIKKLQIQCVVEDDKVGTDMLEEQITAFEDYVQSMDVAAFNKI

SEQ ID NO: 28487 - protein, 225 aa, Homo sapiens; identical to SEQ ID NO: 28486
  Payload ID: 5582
  Gene Symbol: EEF1B2
  Gene Name: eukaryotic translation elongation factor 1 beta 2
  Uniprot ID: P24534
  ENSP ID: ENSP00000376055

SEQ ID NO: 28488 - protein, 225 aa, Homo sapiens; identical to SEQ ID NO: 28486
  Payload ID: 5582
  Gene Symbol: EEF1B2
  Gene Name: eukaryotic translation elongation factor 1 beta 2
  Uniprot ID: P24534
  ENSP ID: ENSP00000376056

SEQ ID NO: 28489 - protein, 68 aa, Homo sapiens
  Payload ID: 5582
  Gene Symbol: EEF1B2
  Gene Name: eukaryotic translation elongation factor 1 beta 2
  ENSP ID: ENSP00000387407
MGFGDLKSPAGLQVCVNVSVSLAGMCHHKQMWQYLKPCPAHRLPTCVMPYVGIITSSLTKRKRPACQE

SEQ ID NO: 28490 - protein, 68 aa, Homo sapiens
  Payload ID: 5582
  Gene Symbol: EEF1B2
  Gene Name: eukaryotic translation elongation factor 1 beta 2
  ENSP ID: ENSP00000393501
MGFGDLKSPAGLQVLNDYLADKSYIEGYVPSQADVAVFEAVSSPPPADLCHALRWYNHIKSYEKEKAR

SEQ ID NO: 28491 - protein, 68 aa, Homo sapiens; identical to SEQ ID NO: 28490
  Payload ID: 5582
  Gene Symbol: EEF1B2
  Gene Name: eukaryotic translation elongation factor 1 beta 2
  ENSP ID: ENSP00000397793

SEQ ID NO: 28492 - protein, 29 aa, Homo sapiens
  Payload ID: 5582
  Gene Symbol: EEF1B2
  Gene Name: eukaryotic translation elongation factor 1 beta 2
  ENSP ID: ENSP00000399917
MGFGDLKSPAGLQVLNDYLADKSYIEGCV

SEQ ID NO: 28493 - protein, 123 aa, Homo sapiens
  Payload ID: 5582
  Gene Symbol: EEF1B2
  Gene Name: eukaryotic translation elongation factor 1 beta 2
  ENSP ID: ENSP00000407730
MGFGDLKSPAGLQVLNDYLADKSYIEGYVPSQADVAVFEAVSSPPPADLCHALRWYNHIKSYEKEKASLPGVKKALGKYGPADVEDTTGSGATDSKDDDDIDLFGSDDEEESEEAKRLREERL

SEQ ID NO: 28494 - protein, 281 aa, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000317399
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 28495 - protein, 281 aa, Homo sapiens; identical to SEQ ID NO: 28494
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000378551

SEQ ID NO: 28496 - protein, 281 aa, Homo sapiens; identical to SEQ ID NO: 28494
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000388261

SEQ ID NO: 28497 - protein, 647 aa, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000391944
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 28498 - protein, 647 aa, Homo sapiens; identical to SEQ ID NO: 28497
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000410059

SEQ ID NO: 28499 - protein, 81 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000431285
MRSGKASCTLETVWEDKHKYEEAERRFYEHEATQAAASAQQLPAEGPAMNGPGQDDPEDADEAEAPDGGSRRDPRKSQDSR

SEQ ID NO: 28500 - protein, 62 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000431307
MRSGKASCTLETVWEDKHKYEEAERRFYEHEATQAAASAQQLPAEGPAMNGPGQDDPEDADE

SEQ ID NO: 28501 - protein, 84 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000431401
MRSGKASCTLETVWEDKHKYEEAERRFYEHEATQAAASAQQLPAEGPAMNGPGQDDPEDADEAEAPDGGSRRDPRKSQDSRKPL

SEQ ID NO: 28502 - protein, 187 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000431460
MATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDM

SEQ ID NO: 28503 - protein, 39 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000431613
MATNFLAHEKIWFDKFKYDDAERRFYEQMNGPVAGASRQ

SEQ ID NO: 28504 - protein, 139 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000431742
MATNFLAHEKIWFDKFKYDDAERRFYEQMNGPVAGASRQENGASVILRDIARARENIQKSLAGSSGPGASSGTSGDHVVQELQQAISKLEARLNVLEKSSPGHRATAPQTQHVSPMRQVEPPAKKPATPAEDDEDDDID

SEQ ID NO: 28505 - protein, 257 aa, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000431763
MATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 28506 - protein, 210 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000431833
  MOD_RES (1)..(1): Any amino acid
XRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQ

SEQ ID NO: 28507 - protein, 137 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000431933
MLPACTRSQERPASRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPG

SEQ ID NO: 28508 - protein, 257 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000432221
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPG

SEQ ID NO: 28509 - protein, 238 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000432429
MATNFLAHEKIWFDKFKYDDAERRFYEQMNGPVAGASRQSSGPGASSGTSGDHVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 28510 - protein, 106 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000432881
MATNFLAHEKIWFDKFKYDDAERRFYEQMNGPVAGASRQSSGPGASSGTSGDHGELVVRIASLEVENQSLRGVVQELQQAISKLEARLNVLEKSSPGHRATAPQTQ

SEQ ID NO: 28511 - protein, 190 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000432919
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDG

SEQ ID NO: 28512 - protein, 180 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000432941
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEW

SEQ ID NO: 28513 - protein, 68 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000433101
MRSGKASCTLETVWEDKHKYEEAERRFYEHEATQAAASAQQLPAEGPAMNGPGQDDPEDADEAEAPDG

SEQ ID NO: 28514 - protein, 21 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000433255
MRSGKASCTLETVWEDKHKYE

SEQ ID NO: 28515 - protein, 31 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000433398
MRSGKASCTLETVWEDKHKYEEAERRFYEHE

SEQ ID NO: 28516 - protein, 168 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000433412
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEED

SEQ ID NO: 28517 - protein, 129 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000433520
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKL

SEQ ID NO: 28518 - protein, 261 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000433611
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEE

SEQ ID NO: 28519 - protein, 179 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000433698
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVE

SEQ ID NO: 28520 - protein, 99 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000433784
MATNFLAHEKIWFDKFKYDDAERRFYEQMNGPVCALSSWTGWSGGLPSWCPWATVSGSYRFSVWWRTTRWGQTCWRRRSPSLRSTCRVSISQLSTRSEA

SEQ ID NO: 28521 - protein, 697 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000434070
MEAPLGSILSPCPGRAATGRAGTGRVGTGLRPPAVLQLCPLLAFYRCVRKMRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 28522 - protein, 39 aa, Homo sapiens; identical to SEQ ID NO: 28503
  Payload ID: 5583
  Gene Symbol: EEF1D
  Gene Name: eukaryotic translation elongation factor 1 delta (guanine nucleotide exchange protein)
  ENSP ID: ENSP00000434123

SEQ ID NO: 28523 - protein, 300 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000434389
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPS

SEQ ID NO: 28524 - protein, 198 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000434448
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSI

SEQ ID NO: 28525 - protein, 204 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000434691
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKP

SEQ ID NO: 28526 - protein, 281 aa, Homo sapiens; identical to SEQ ID NO: 28494
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000434872

SEQ ID NO: 28527 - protein, 119 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000435015
GSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHSVDIAAFNKI

SEQ ID NO: 28528 - protein, 156 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000435117
  MOD_RES (1)..(1): Any amino acid
XPLWQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 28529 - protein, 63 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000435477
MATNFLAHEKIWFDKFKYDDAERRFYEQMNGPVAGASRQENGASVILRDIARARENIQKSLAG

SEQ ID NO: 28530 - protein, 36 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000435617
MRSGKASCTLETVWEDKHKYEEAERRFYEHEATQAA

SEQ ID NO: 28531 - protein, 257 aa, Homo sapiens; identical to SEQ ID NO: 28505
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000435697

SEQ ID NO: 28532 - protein, 49 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000435719
MRSGKASCTLETVWEDKHKYEEAERRFYEHEATQAAASAQQLPAEGPAM

SEQ ID NO: 28533 - protein, 130 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000436045
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQ

SEQ ID NO: 28534 - protein, 157 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000436251
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACH

SEQ ID NO: 28535 - protein, 262 aa, Homo sapiens
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000436507
MATNFLAHEKIWFDKFKYDDAERRFYEQMNGPVAGASRQENGASVILRDIARARENIQKSLAGSSGPGASSGTSGDHVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 28536 - protein, 204 aa, Homo sapiens; identical to SEQ ID NO: 28525
  Payload ID: 5583
  Gene Symbol: EEF1D
  Gene Name: eukaryotic translation elongation factor 1 delta (guanine nucleotide exchange protein)
  ENSP ID: ENSP00000436542

SEQ ID NO: 28537 - protein, 53 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000436718
MRSGKASCTLETVWEDKHKYEEAERRFYEHEATQAAASAQQLPAEGPAMNGPG

SEQ ID NO: 28538 - protein, 36 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000436880
MAQLEACVRSIQLDGLVWGASKLVPVGYGIRKLQIQ

SEQ ID NO: 28539 - protein, 166 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000436933
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEE

SEQ ID NO: 28540 - protein, 35 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000437117
MATNFLAHEKIWFDKFKYDDAERRFYEQMNGPVAG

SEQ ID NO: 28541 - protein, 146 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000437223
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWG

SEQ ID NO: 28542 - protein, 130 aa, Homo sapiens; identical to SEQ ID NO: 28533
  Payload ID: 5583
  Gene Symbol: EEF1D
  Gene Name: eukaryotic translation elongation factor 1 delta (guanine nucleotide exchange protein)
  ENSP ID: ENSP00000437276

SEQ ID NO: 28543 - protein, 647 aa, Homo sapiens; identical to SEQ ID NO: 28497
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000477608

SEQ ID NO: 28544 - protein, 631 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000478271
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVGGRQGGDRLAGGGDHQV

SEQ ID NO: 28545 - protein, 281 aa, Homo sapiens; identical to SEQ ID NO: 28494
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000478340

SEQ ID NO: 28546 - protein, 281 aa, Homo sapiens; identical to SEQ ID NO: 28494
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000479653

SEQ ID NO: 28547 - protein, 647 aa, Homo sapiens; identical to SEQ ID NO: 28497
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000480505

SEQ ID NO: 28548 - protein, 281 aa, Homo sapiens; identical to SEQ ID NO: 28494
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000483527

SEQ ID NO: 28549 - protein, 631 aa, Homo sapiens; identical to SEQ ID NO: 28544
  Payload ID: 5583
  Gene Symbol: EEF1D
  Gene Name: eukaryotic translation elongation factor 1 delta (guanine nucleotide exchange protein)
  ENSP ID: ENSP00000484536

SEQ ID NO: 28550 - protein, 179 aa, Homo sapiens; identical to SEQ ID NO: 28519
  Payload ID: 5583
  Gene Symbol: EEF1D
  Gene Name: eukaryotic translation elongation factor 1 delta (guanine nucleotide exchange protein)
  ENSP ID: ENSP00000487621

SEQ ID NO: 28551 - protein, 21 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000487622
MRSGKASCTLETVWEDKHKYE

SEQ ID NO: 28552 - protein, 84 aa, Homo sapiens; identical to SEQ ID NO: 28501
  Payload ID: 5583
  Gene Symbol: EEF1D
  Gene Name: eukaryotic translation elongation factor 1 delta (guanine nucleotide exchange protein)
  ENSP ID: ENSP00000487641

SEQ ID NO: 28553 - protein, 281 aa, Homo sapiens; identical to SEQ ID NO: 28494
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000487680

SEQ ID NO: 28554 - protein, 198 aa, Homo sapiens; identical to SEQ ID NO: 28524
  Payload ID: 5583
  Gene Symbol: EEF1D
  Gene Name: eukaryotic translation elongation factor 1 delta (guanine nucleotide exchange protein)
  ENSP ID: ENSP00000487710

SEQ ID NO: 28555 - protein, 166 aa, Homo sapiens; identical to SEQ ID NO: 28539
  Payload ID: 5583
  Gene Symbol: EEF1D
  Gene Name: eukaryotic translation elongation factor 1 delta (guanine nucleotide exchange protein)
  ENSP ID: ENSP00000487713

SEQ ID NO: 28556 - protein, 261 aa, Homo sapiens; identical to SEQ ID NO: 28518
  Payload ID: 5583
  Gene Symbol: EEF1D
  Gene Name: eukaryotic translation elongation factor 1 delta (guanine nucleotide exchange protein)
  ENSP ID: ENSP00000487745

SEQ ID NO: 28557 - protein, 35 aa, Homo sapiens; identical to SEQ ID NO: 28540
  Payload ID: 5583
  Gene Symbol: EEF1D
  Gene Name: eukaryotic translation elongation factor 1 delta (guanine nucleotide exchange protein)
  ENSP ID: ENSP00000487777

SEQ ID NO: 28558 - protein, 53 aa, Homo sapiens; identical to SEQ ID NO: 28537
  Payload ID: 5583
  Gene Symbol: EEF1D
  Gene Name: eukaryotic translation elongation factor 1 delta (guanine nucleotide exchange protein)
  ENSP ID: ENSP00000487871

SEQ ID NO: 28559 - protein, 68 aa, Homo sapiens; identical to SEQ ID NO: 28513
  Payload ID: 5583
  Gene Symbol: EEF1D
  Gene Name: eukaryotic translation elongation factor 1 delta (guanine nucleotide exchange protein)
  ENSP ID: ENSP00000487890

SEQ ID NO: 28560 - protein, 62 aa, Homo sapiens; identical to SEQ ID NO: 28500
  Payload ID: 5583
  Gene Symbol: EEF1D
  Gene Name: eukaryotic translation elongation factor 1 delta (guanine nucleotide exchange protein)
  ENSP ID: ENSP00000487932

SEQ ID NO: 28561 - protein, 238 aa, Homo sapiens; identical to SEQ ID NO: 28509
  Payload ID: 5583
  Gene Symbol: EEF1D
  Gene Name: eukaryotic translation elongation factor 1 delta (guanine nucleotide exchange protein)
  ENSP ID: ENSP00000488005

SEQ ID NO: 28562 - protein, 257 aa, Homo sapiens; identical to SEQ ID NO: 28505
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000488026

SEQ ID NO: 28563 - protein, 157 aa, Homo sapiens; identical to SEQ ID NO: 28534
  Payload ID: 5583
  Gene Symbol: EEF1D
  Gene Name: eukaryotic translation elongation factor 1 delta (guanine nucleotide exchange protein)
  ENSP ID: ENSP00000488129

SEQ ID NO: 28564 - protein, 36 aa, Homo sapiens; identical to SEQ ID NO: 28530
  Payload ID: 5583
  Gene Symbol: EEF1D
  Gene Name: eukaryotic translation elongation factor 1 delta (guanine nucleotide exchange protein)
  ENSP ID: ENSP00000488167

SEQ ID NO: 28565 - protein, 168 aa, Homo sapiens; identical to SEQ ID NO: 28516
  Payload ID: 5583
  Gene Symbol: EEF1D
  Gene Name: eukaryotic translation elongation factor 1 delta (guanine nucleotide exchange protein)
  ENSP ID: ENSP00000488200

SEQ ID NO: 28566 - protein, 81 aa, Homo sapiens; identical to SEQ ID NO: 28499
  Payload ID: 5583
  Gene Symbol: EEF1D
  Gene Name: eukaryotic translation elongation factor 1 delta (guanine nucleotide exchange protein)
  ENSP ID: ENSP00000488220

SEQ ID NO: 28567 - protein, 204 aa, Homo sapiens; identical to SEQ ID NO: 28525
  Payload ID: 5583
  Gene Symbol: EEF1D
  Gene Name: eukaryotic translation elongation factor 1 delta (guanine nucleotide exchange protein)
  ENSP ID: ENSP00000488233

SEQ ID NO: 28568 - protein, 180 aa, Homo sapiens; identical to SEQ ID NO: 28512
  Payload ID: 5583
  Gene Symbol: EEF1D
  Gene Name: eukaryotic translation elongation factor 1 delta (guanine nucleotide exchange protein)
  ENSP ID: ENSP00000488244

SEQ ID NO: 28569 - protein, 146 aa, Homo sapiens; identical to SEQ ID NO: 28541
  Payload ID: 5583
  Gene Symbol: EEF1D
  Gene Name: eukaryotic translation elongation factor 1 delta (guanine nucleotide exchange protein)
  ENSP ID: ENSP00000488247

SEQ ID NO: 28570 - protein, 257 aa, Homo sapiens; identical to SEQ ID NO: 28505
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000488275

SEQ ID NO: 28571 - protein, 63 aa, Homo sapiens; identical to SEQ ID NO: 28529
  Payload ID: 5583
  Gene Symbol: EEF1D
  Gene Name: eukaryotic translation elongation factor 1 delta (guanine nucleotide exchange protein)
  ENSP ID: ENSP00000488298

SEQ ID NO: 28572 - protein, 31 aa, Homo sapiens; identical to SEQ ID NO: 28515
  Payload ID: 5583
  Gene Symbol: EEF1D
  Gene Name: eukaryotic translation elongation factor 1 delta (guanine nucleotide exchange protein)
  ENSP ID: ENSP00000488400

SEQ ID NO: 28573 - protein, 300 aa, Homo sapiens; identical to SEQ ID NO: 28523
  Payload ID: 5583
  Gene Symbol: EEF1D
  Gene Name: eukaryotic translation elongation factor 1 delta (guanine nucleotide exchange protein)
  ENSP ID: ENSP00000488411

SEQ ID NO: 28574 - protein, 99 aa, Homo sapiens; identical to SEQ ID NO: 28520
  Payload ID: 5583
  Gene Symbol: EEF1D
  Gene Name: eukaryotic translation elongation factor 1 delta (guanine nucleotide exchange protein)
  ENSP ID: ENSP00000488514

SEQ ID NO: 28575 - protein, 139 aa, Homo sapiens; identical to SEQ ID NO: 28504
  Payload ID: 5583
  Gene Symbol: EEF1D
  Gene Name: eukaryotic translation elongation factor 1 delta (guanine nucleotide exchange protein)
  ENSP ID: ENSP00000488535

SEQ ID NO: 28576 - protein, 109 aa, Homo sapiens
  Payload ID: 5583
  Gene Symbol: EEF1D
  Gene Name: eukaryotic translation elongation factor 1 delta (guanine nucleotide exchange protein)
  ENSP ID: ENSP00000488544
PGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPK

SEQ ID NO: 28577 - protein, 39 aa, Homo sapiens; identical to SEQ ID NO: 28503
  Payload ID: 5583
  Gene Symbol: EEF1D
  Gene Name: eukaryotic translation elongation factor 1 delta (guanine nucleotide exchange protein)
  ENSP ID: ENSP00000488549

SEQ ID NO: 28578 - protein, 204 aa, Homo sapiens; identical to SEQ ID NO: 28525
  Payload ID: 5583
  Gene Symbol: EEF1D
  Gene Name: eukaryotic translation elongation factor 1 delta (guanine nucleotide exchange protein)
  ENSP ID: ENSP00000488663

SEQ ID NO: 28579 - protein, 262 aa, Homo sapiens; identical to SEQ ID NO: 28535
  Payload ID: 5583
  Gene Symbol: EEF1D
  Gene Name: eukaryotic translation elongation factor 1 delta (guanine nucleotide exchange protein)
  Uniprot ID: P29692
  ENSP ID: ENSP00000488672

SEQ ID NO: 28580 - protein, 49 aa, Homo sapiens; identical to SEQ ID NO: 28532
  Payload ID: 5583
  Gene Symbol: EEF1D
  Gene Name: eukaryotic translation elongation factor 1 delta (guanine nucleotide exchange protein)
  ENSP ID: ENSP00000488681

SEQ ID NO: 28581 - protein, 257 aa, Homo sapiens; identical to SEQ ID NO: 28508
  Payload ID: 5583
  Gene Symbol: EEF1D
  Gene Name: eukaryotic translation elongation factor 1 delta (guanine nucleotide exchange protein)
  ENSP ID: ENSP00000488733

SEQ ID NO: 28582 - protein, 129 aa, Homo sapiens; identical to SEQ ID NO: 28517
  Payload ID: 5583
  Gene Symbol: EEF1D
  Gene Name: eukaryotic translation elongation factor 1 delta (guanine nucleotide exchange protein)
  ENSP ID: ENSP00000488738

SEQ ID NO: 28583 - protein, 190 aa, Homo sapiens; identical to SEQ ID NO: 28511
  Payload ID: 5583
  Gene Symbol: EEF1D
  Gene Name: eukaryotic translation elongation factor 1 delta (guanine nucleotide exchange protein)
  ENSP ID: ENSP00000488795

SEQ ID NO: 28584 - protein, 187 aa, Homo sapiens; identical to SEQ ID NO: 28502
  Payload ID: 5583
  Gene Symbol: EEF1D
  Gene Name: eukaryotic translation elongation factor 1 delta (guanine nucleotide exchange protein)
  ENSP ID: ENSP00000488901

SEQ ID NO: 28585 - protein, 174 aa, Homo sapiens
  Payload ID: 5584
  Gene Symbol: EEF1E1
  Gene Name: eukaryotic translation elongation factor 1 epsilon 1
  Uniprot ID: O43324
  ENSP ID: ENSP00000369038
MAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIVDLTVQEKEKYLNVSRWFCHIQHYPGIRQHLSSVVFIKNRLYTNSH

SEQ ID NO: 28586 - protein, 139 aa, Homo sapiens
  Payload ID: 5584
  Gene Symbol: EEF1E1
  Gene Name: eukaryotic translation elongation factor 1 epsilon 1
  Uniprot ID: O43324
  ENSP ID: ENSP00000414363
MAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIIRKLRHTEVGN

SEQ ID NO: 28587 - protein, 150 aa, Homo sapiens
  Payload ID: 5584
  Gene Symbol: EEF1E1
  Gene Name: eukaryotic translation elongation factor 1 epsilon 1
  ENSP ID: ENSP00000424222
MAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIVSICIVTGFFSVVLRMIFKTLS

SEQ ID NO: 28588 - protein, 94 aa, Homo sapiens
  Payload ID: 5584
  Gene Symbol: EEF1E1
  Gene Name: eukaryotic translation elongation factor 1 epsilon 1
  ENSP ID: ENSP00000425577
MAERTPKESWPNLGDSGKAFLKPWIISLSVTTHSECGKHHKIPVLQTNNGPSLTGLTTIAAHLVKQANKEYLLGSTAEEKAIVQQWLEYRVTQV

SEQ ID NO: 28589 - protein, 56 aa, Homo sapiens
  Payload ID: 5584
  Gene Symbol: EEF1E1
  Gene Name: eukaryotic translation elongation factor 1 epsilon 1
  ENSP ID: ENSP00000427143
VDGHSSKNDIHTLLKVLTLSPRLECNGVILAHCNLRLLGSSDSRASASRVNGITGS

SEQ ID NO: 28590 - protein, 136 aa, Homo sapiens
  Payload ID: 5584
  Gene Symbol: EEF1E1
  Gene Name: eukaryotic translation elongation factor 1 epsilon 1
  ENSP ID: ENSP00000427572
  MOD_RES (1)..(1): Any amino acid
XGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIANHDCFVYKKMRIVTGPHVCL

SEQ ID NO: 28591 - protein, 437 aa, Homo sapiens
  Payload ID: 5585
  Gene Symbol: EEF1G
  Gene Name: eukaryotic translation elongation factor 1 gamma
  Uniprot ID: P26641
  ENSP ID: ENSP00000331901
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 28592 - protein, 858 aa, Homo sapiens
  Payload ID: 5586
  Gene Symbol: EEF2
  Gene Name: eukaryotic translation elongation factor 2
  Uniprot ID: P13639
  ENSP ID: ENSP00000307940
MVNFTVDQIRAIMDKKANIRNMSVIAHVDHGKSTLTDSLVCKAGIIASARAGETRFTDTRKDEQERCITIKSTAISLFYELSENDLNFIKQSKDGAGFLINLIDSPGHVDFSSEVTAALRVTDGALVVVDCVSGVCVQTETVLRQAIAERIKPVLMMNKMDRALLELQLEPEELYQTFQRIVENVNVIISTYGEGESGPMGNIMIDPVLGTVGFGSGLHGWAFTLKQFAEMYVAKFAAKGEGQLGPAERAKKVEDMMKKLWGDRYFDPANGKFSKSATSPEGKKLPRTFCQLILDPIFKVFDAIMNFKKEETAKLIEKLDIKLDSEDKDKEGKPLLKAVMRRWLPAGDALLQMITIHLPSPVTAQKYRCELLYEGPPDDEAAMGIKSCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 28593 - protein, 85 aa, Homo sapiens
  Payload ID: 5586
  Gene Symbol: EEF2
  Gene Name: eukaryotic translation elongation factor 2
  ENSP ID: ENSP00000471265
  MOD_RES (1)..(1): Any amino acid
XEESNVLCLSKSPNKHNRLYMKARPFPDGLAEDIDKGGMGHPTLFPFLQRETQMSKLILTNALRGLFGYMARSGFCPRKGKGTRG

SEQ ID NO: 28594 - protein, 113 aa, Homo sapiens
  Payload ID: 5587
  Gene Symbol: EIF1
  Gene Name: eukaryotic translation initiation factor 1
  Uniprot ID: P41567
  ENSP ID: ENSP00000419449
MSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFLVEIGLAKDDQLKVHGF

SEQ ID NO: 28595 - protein, 121 aa, Homo sapiens
  Payload ID: 5587
  Gene Symbol: EIF1
  Gene Name: eukaryotic translation initiation factor 1
  ENSP ID: ENSP00000466321
MSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFLVEIGLAKDDQLKVHGFKNLTACIM

SEQ ID NO: 28596 - protein, 53 aa, Homo sapiens
  Payload ID: 5587
  Gene Symbol: EIF1
  Gene Name: eukaryotic translation initiation factor 1
  ENSP ID: ENSP00000467918
DYDKKKLVKAFKKKFACNGTVIEHPEYGEVIQLQGDQRKNICQFLVEVSSVTT

SEQ ID NO: 28597 - protein, 165 aa, Homo sapiens
  Payload ID: 5588
  Gene Symbol: EIF1AD
  Gene Name: eukaryotic translation initiation factor 1A domain containing
  Uniprot ID: Q8N9N8
  ENSP ID: ENSP00000309175
MSQATKRKHVVKEVLGEHIVPSDQQQIVRVLRTPGNNLHEVETAQGQRFLVSMPSKYRKNIWIKRGDFLIVDPIEEGEKVKAEISFVLCKDHVRSLQKEGFWPEAFSEVAEKHNNRNRQTQPELPAEPQLSGEESSSEDDSDLFVNTNRRQYHESEEESEEEEAA

SEQ ID NO: 28598 - protein, 78 aa, Homo sapiens
  Payload ID: 5588
  Gene Symbol: EIF1AD
  Gene Name: eukaryotic translation initiation factor 1A domain containing
  ENSP ID: ENSP00000432135
MSQATKRKHVVKEVLGEHIVPSDQQQIVRVLRTPGNNLHEVETAQGQRFLVSMPSKYRKNIWIKRGDFLIVDPIEEGE

SEQ ID NO: 28599 - protein, 113 aa, Homo sapiens
  Payload ID: 5588
  Gene Symbol: EIF1AD
  Gene Name: eukaryotic translation initiation factor 1A domain containing
  ENSP ID: ENSP00000433320
MSQATKRKHVVKEVLGEHIVPSDQQQIVRVLRTPGNNLHEVETAQGQRFLVSMPSKYRKNIWIKRGDFLIVDPIEEGEKVKAEISFVLCKDHVRSLQKEGFWPEAFSEVAEKH

SEQ ID NO: 28600 - protein, 165 aa, Homo sapiens; identical to SEQ ID NO: 28597
  Payload ID: 5588
  Gene Symbol: EIF1AD
  Gene Name: eukaryotic translation initiation factor 1A domain containing
  Uniprot ID: Q8N9N8
  ENSP ID: ENSP00000434056

SEQ ID NO: 28601 - protein, 113 aa, Homo sapiens
  Payload ID: 5588
  Gene Symbol: EIF1AD
  Gene Name: eukaryotic translation initiation factor 1A domain containing
  ENSP ID: ENSP00000434796
MPSKYRKNIWIKRGDFLIVDPIEEGEKVKAEISFVLCKDHVRSLQKEGFWPEAFSEVAEKHNNRNRQTQPELPAEPQLSGEESSSEDDSDLFVNTNRRQYHESEEESEEEEAA

SEQ ID NO: 28602 - protein, 165 aa, Homo sapiens; identical to SEQ ID NO: 28597
  Payload ID: 5588
  Gene Symbol: EIF1AD
  Gene Name: eukaryotic translation initiation factor 1A domain containing
  Uniprot ID: Q8N9N8
  ENSP ID: ENSP00000435439

SEQ ID NO: 28603 - protein, 114 aa, Homo sapiens
  Payload ID: 5588
  Gene Symbol: EIF1AD
  Gene Name: eukaryotic translation initiation factor 1A domain containing
  ENSP ID: ENSP00000435891
MSQATKRKHVVKEVLGEHIVPSDQQQIVRVLRTPGNNLHEVETAQGQRFLVSMPSKYRKNIWIKRGDFLIVDPIEEGEKVKAEISFVLCKDHVRSLQKEGFWPEAFSEVAEKHN

SEQ ID NO: 28604 - protein, 165 aa, Homo sapiens; identical to SEQ ID NO: 28597
  Payload ID: 5588
  Gene Symbol: EIF1AD
  Gene Name: eukaryotic translation initiation factor 1A domain containing
  Uniprot ID: Q8N9N8
  ENSP ID: ENSP00000435942

SEQ ID NO: 28605 - protein, 165 aa, Homo sapiens; identical to SEQ ID NO: 28597
  Payload ID: 5588
  Gene Symbol: EIF1AD
  Gene Name: eukaryotic translation initiation factor 1A domain containing
  Uniprot ID: Q8N9N8
  ENSP ID: ENSP00000436644

SEQ ID NO: 28606 - protein, 64 aa, Homo sapiens
  Payload ID: 5588
  Gene Symbol: EIF1AD
  Gene Name: eukaryotic translation initiation factor 1A domain containing
  ENSP ID: ENSP00000436876
MSQATKRKHVVKEVLGEHIVPSDQQQIVRVLRTPGNNLHEVETAQGQRFLGTFSLLTPLKREKR

SEQ ID NO: 28607 - protein, 116 aa, Homo sapiens
  Payload ID: 5589
  Gene Symbol: EIF1AX
  Gene Name: eukaryotic translation initiation factor 1A, X-linked
  ENSP ID: ENSP00000368912
MPKNKEYAQVIKMLGNGRLEAMCFDGVKRLCHIRGKLRKKVWINTSDIILVGLRDYQDNKADVILKYNADEARSLKAYGELPEHAKINETDTFGPGDDDEIQFDDIGDDDEDIDDI

SEQ ID NO: 28608 - protein, 144 aa, Homo sapiens
  Payload ID: 5589
  Gene Symbol: EIF1AX
  Gene Name: eukaryotic translation initiation factor 1A, X-linked
  Uniprot ID: P47813
  ENSP ID: ENSP00000368927
MPKNKGKGGKNRRRGKNENESEKRELVFKEDGQEYAQVIKMLGNGRLEAMCFDGVKRLCHIRGKLRKKVWINTSDIILVGLRDYQDNKADVILKYNADEARSLKAYGELPEHAKINETDTFGPGDDDEIQFDDIGDDDEDIDDI

SEQ ID NO: 28609 - protein, 144 aa, Homo sapiens
  Payload ID: 5590
  Gene Symbol: EIF1AY
  Gene Name: eukaryotic translation initiation factor 1A, Y-linked
  Uniprot ID: O14602
  ENSP ID: ENSP00000354722
MPKNKGKGGKNRRRGKNENESEKRELVFKEDGQEYAQVIKMLGNGRLEALCFDGVKRLCHIRGKLRKKVWINTSDIILVGLRDYQDNKADVILKYNADEARSLKAYGELPEHAKINETDTFGPGDDDEIQFDDIGDDDEDIDDI

SEQ ID NO: 28610 - protein, 127 aa, Homo sapiens
  Payload ID: 5590
  Gene Symbol: EIF1AY
  Gene Name: eukaryotic translation initiation factor 1A, Y-linked
  ENSP ID: ENSP00000372222
MPKNKGKGGKNRRRGKNENESEKRELVFKEDGQEYAQVIKMLGNGRLEALCFDGVKRLCHIRGKLRKKDNKADVILKYNADEARSLKAYGELPEHAKINETDTFGPGDDDEIQFDDIGDDDEDIDDI

SEQ ID NO: 28611 - protein, 113 aa, Homo sapiens
  Payload ID: 5591
  Gene Symbol: EIF1B
  Gene Name: eukaryotic translation initiation factor 1B
  Uniprot ID: O60739
  ENSP ID: ENSP00000232905
MSTIQNLQSFDPFADATKGDDLLPAGTEDYIHIRIQQRNGRKTLTTVQGIADDYDKKKLVKAFKKKFACNGTVIEHPEYGEVIQLQGDQRKNICQFLLEVGIVKEEQLKVHGF

SEQ ID NO: 28612 - protein, 1649 aa, Homo sapiens
  Payload ID: 5592
  Gene Symbol: EIF2AK4
  Gene Name: eukaryotic translation initiation factor 2 alpha kinase 4
  Uniprot ID: Q9P2K8
  ENSP ID: ENSP00000263791
MAGGRGAPGRGRDEPPESYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEVMIFELAYHVQSFLSEHNKPPPKSFHEEMLERRAQEEQQRLLEAKRKEEQEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSEGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQDEDCNEKNGCHESEPSVTTEAVHYLYIQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 28613 - protein, 616 aa, Homo sapiens
  Payload ID: 5592
  Gene Symbol: EIF2AK4
  Gene Name: eukaryotic translation initiation factor 2 alpha kinase 4
  Uniprot ID: Q9P2K8
  ENSP ID: ENSP00000453148
MAGGRGAPGRGRDEPPESYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEVMIFELAYHVQSFLSEHNKPPPKSFHEEMLERRAQEEQQRLLEAKRKEEQEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSEGQDYVETVIPSNRLPSAAFFSETQRQFSRYFIEFEELQLLGKGAFGAVIKVWYRVIPSPL

SEQ ID NO: 28614 - protein, 1427 aa, Homo sapiens
  Payload ID: 5592
  Gene Symbol: EIF2AK4
  Gene Name: eukaryotic translation initiation factor 2 alpha kinase 4
  ENSP ID: ENSP00000453575
  MOD_RES (1)..(1): Any amino acid
XAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSEGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 28615 - protein, 136 aa, Homo sapiens
  Payload ID: 5592
  Gene Symbol: EIF2AK4
  Gene Name: eukaryotic translation initiation factor 2 alpha kinase 4
  ENSP ID: ENSP00000453968
MAGGRGAPGRGRDEPPESYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEQQGWRGLTPTLKEVQV

SEQ ID NO: 28616 - protein, 80 aa, Homo sapiens
  Payload ID: 5592
  Gene Symbol: EIF2AK4
  Gene Name: eukaryotic translation initiation factor 2 alpha kinase 4
  ENSP ID: ENSP00000454210
  MOD_RES (1)..(1): Any amino acid
XIVSVLAPEKLSASTRRRYETQWDADEQAFNTTVKQLLSRLPKQRYLKLVCDEIYNIKVEKKVSVLFLYSYRDDYYRILF

SEQ ID NO: 28617 - protein, 315 aa, Homo sapiens
  Payload ID: 5593
  Gene Symbol: EIF2S1
  Gene Name: eukaryotic translation initiation factor 2, subunit 1 alpha, 35kDa
  Uniprot ID: P05198
  ENSP ID: ENSP00000256383
MPGLSCRFYQHKFPEVEDVVMVNVRSIAEMGAYVSLLEYNNIEGMILLSELSRRRIRSINKLIRIGRNECVVVIRVDKEKGYIDLSKRRVSPEEAIKCEDKFTKSKTVYSILRHVAEVLEYTKDEQLESLFQRTAWVFDDKYKRPGYGAYDAFKHAVSDPSILDSLDLNEDEREVLINNINRRLTPQAVKIRADIEVACYGYEGIDAVKEALRAGLNCSTENMPIKINLIAPPRYVMTTTTLERTEGLSVLSQAMAVIKEKIEEKRGVFNVQMEPKVVTDTDETELARQMERLERENAEVDGDDDAEEMEAKAED

SEQ ID NO: 28618 - protein, 315 aa, Homo sapiens; identical to SEQ ID NO: 28617
  Payload ID: 5593
  Gene Symbol: EIF2S1
  Gene Name: eukaryotic translation initiation factor 2, subunit 1 alpha, 35kDa
  Uniprot ID: P05198
  ENSP ID: ENSP00000425299

SEQ ID NO: 28619 - protein, 273 aa, Homo sapiens
  Payload ID: 5593
  Gene Symbol: EIF2S1
  Gene Name: eukaryotic translation initiation factor 2, subunit 1 alpha, 35kDa
  ENSP ID: ENSP00000451975
MPGLSCRFYQHKFPEVEDVVMVNVRSIAEMGAYVSLLEYNNIEGMILLSELSRRRIRSINKLIRIGRNECVVVIRVDKEKGYIDLSKRRVSPEEAIKCEDKFTKSKTVYSILRHVAEVLEYTKDEQLESLFQRTAWVFDDKYKRPGYGAYDAFKHAVSDPSILDSLDLNEDEREVLINNINRRLTPQAVKIRADIEVACYGYEGIDAVKEALRAGLNCSTENMPIKINLIAPPRYVMTTTTLERTEGLSVLSQAMAVIKEKIEEKRGVFNVQM

SEQ ID NO: 28620 - protein, 252 aa, Homo sapiens
  Payload ID: 5593
  Gene Symbol: EIF2S1
  Gene Name: eukaryotic translation initiation factor 2, subunit 1 alpha, 35kDa
  ENSP ID: ENSP00000452034
  MOD_RES (1)..(1): Any amino acid
XMILLSELSRRRIRSINKLIRIGRNECVVVIRVDKEKGYIDLSKRRVSPEEAIKCEDKFTKSKTVYSILRHVAEVLEYTKDEQLESLFQRTAWVFDDKYKRPGYGAYDAFKHAVSDPSILDSLDLNEDEREVLINNINRRLTPQAVKIRADIEVACYGYEGIDAVKEALRAGLNCSTENMPIKINLIAPPRYVMTTTTLERTEGLSVLSQAMAVIKEKIEEKRGVFNVQMEVRSIDSFLIMTQEVPKRSSCR

SEQ ID NO: 28621 - protein, 333 aa, Homo sapiens
  Payload ID: 5594
  Gene Symbol: EIF2S2
  Gene Name: eukaryotic translation initiation factor 2, subunit 2 beta, 38kDa
  Uniprot ID: P20042
  ENSP ID: ENSP00000364119
MSGDEMIFDPTMSKKKKKKKKPFMLDEEGDTQTEETQPSETKEVEPEPTEDKDLEADEEDTRKKDASDDLDDLNFFNQKKKKKKTKKIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 28622 - protein, 472 aa, Homo sapiens
  Payload ID: 5595
  Gene Symbol: EIF2S3
  Gene Name: eukaryotic translation initiation factor 2, subunit 3 gamma, 52kDa
  Uniprot ID: P41091
  ENSP ID: ENSP00000253039
MAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIAGNESCPQPQTSEHLAAIEIMKLKHILILQNKIDLVKESQAKEQYEQILAFVQGTVAEGAPIIPISAQLKYNIEVVCEYIVKKIPVPPRDFTSEPRLIVIRSFDVNKPGCEVDDLKGGVAGGSILKGVLKVGQEIEVRPGIVSKDSEGKLMCKPIFSKIVSLFAEHNDLQYAAPGGLIGVGTKIDPTLCRADRMVGQVLGAVGALPEIFTELEISYFLLRRLLGVRTEGDKKAAKVQKLSKNEVLMVNIGSLSTGGRVSAVKADLGKIVLTNPVCTEVGEKIALSRRVEKHWRLIGWGQIRRGVTIKPTVDDD

SEQ ID NO: 28623 - protein, 183 aa, Homo sapiens
  Payload ID: 5595
  Gene Symbol: EIF2S3
  Gene Name: eukaryotic translation initiation factor 2, subunit 3 gamma, 52kDa
  ENSP ID: ENSP00000391383
  MOD_RES (1)..(1): Any amino acid
XAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIGKYLTIGLDKSMWNKSKMKYLKGN

SEQ ID NO: 28624 - protein, 580 aa, Homo sapiens
  Payload ID: 5596
  Gene Symbol: EIF2A
  Gene Name: eukaryotic translation initiation factor 2A, 65kDa
  ENSP ID: ENSP00000273435
MAPSTPLLTVRGSEGLYMVNGPPHFTESTVFPRESGKNCKVCIFSKDGTLFAWGNGENVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 28625 - protein, 524 aa, Homo sapiens
  Payload ID: 5596
  Gene Symbol: EIF2A
  Gene Name: eukaryotic translation initiation factor 2A, 65kDa
  Uniprot ID: Q9BY44
  ENSP ID: ENSP00000385292
MAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 28626 - protein, 585 aa, Homo sapiens
  Payload ID: 5596
  Gene Symbol: EIF2A
  Gene Name: eukaryotic translation initiation factor 2A, 65kDa
  Uniprot ID: Q9BY44
  ENSP ID: ENSP00000417229
MAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 28627 - protein, 75 aa, Homo sapiens
  Payload ID: 5596
  Gene Symbol: EIF2A
  Gene Name: eukaryotic translation initiation factor 2A, 65kDa
  ENSP ID: ENSP00000417575
MAPSTPLLTVRGSEGLYMVNGPPHFTESTVFPRDRVSPCCPAGLELPTSGDPPASASQTAGITGGIWEELQSLYL

SEQ ID NO: 28628 - protein, 236 aa, Homo sapiens
  Payload ID: 5596
  Gene Symbol: EIF2A
  Gene Name: eukaryotic translation initiation factor 2A, 65kDa
  ENSP ID: ENSP00000418698
MAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFIGSRVSASGSFLDTIANKLHLQKINDFVLSPGPQPYKVAVYVPGSKGAPSFVRLYQYPNFAGPHAALANKSFFKADKV

SEQ ID NO: 28629 - protein, 59 aa, Homo sapiens
  Payload ID: 5596
  Gene Symbol: EIF2A
  Gene Name: eukaryotic translation initiation factor 2A, 65kDa
  ENSP ID: ENSP00000419456
MAPSTPLLTVRGSEGLYMVNGPPHFTESTVFPRESGKNCKVCIFSKDGTLFAWGNGENF

SEQ ID NO: 28630 - protein, 158 aa, Homo sapiens
  Payload ID: 5596
  Gene Symbol: EIF2A
  Gene Name: eukaryotic translation initiation factor 2A, 65kDa
  ENSP ID: ENSP00000420493
  MOD_RES (1)..(1): Any amino acid
XVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFSGCLCSRK

SEQ ID NO: 28631 - protein, 40 aa, Homo sapiens
  Payload ID: 5596
  Gene Symbol: EIF2A
  Gene Name: eukaryotic translation initiation factor 2A, 65kDa
  ENSP ID: ENSP00000420495
HAALDSPRIRRTVHGEWTTTFYRKHSVSKGIWEELQSLYL

SEQ ID NO: 28632 - protein, 560 aa, Homo sapiens
  Payload ID: 5596
  Gene Symbol: EIF2A
  Gene Name: eukaryotic translation initiation factor 2A, 65kDa
  Uniprot ID: Q9BY44
  ENSP ID: ENSP00000420537
MAPSTPLLTVRGSEGLYMVNGPPHFTESTVFPRVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 28633 - protein, 316 aa, Homo sapiens
  Payload ID: 5596
  Gene Symbol: EIF2A
  Gene Name: eukaryotic translation initiation factor 2A, 65kDa
  ENSP ID: ENSP00000420611
  MOD_RES (1)..(1): Any amino acid
XWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQKLKAIEQLKEQAATGKQLEKNQLEKIQKETALLQELEDLELGI

SEQ ID NO: 28634 - protein, 630 aa, Homo sapiens
  Payload ID: 5597
  Gene Symbol: EIF2AK1
  Gene Name: eukaryotic translation initiation factor 2-alpha kinase 1
  Uniprot ID: Q9BQI3
  ENSP ID: ENSP00000199389
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 28635 - protein, 81 aa, Homo sapiens
  Payload ID: 5597
  Gene Symbol: EIF2AK1
  Gene Name: eukaryotic translation initiation factor 2-alpha kinase 1
  ENSP ID: ENSP00000392459
MQGGNSGVRKREEEGDGAGAVAAPPAIDFPAEGPDPEYDEMWSCCVSQAGLERLASSDSPASAFQNAGIIDNLMFQQKSRC

SEQ ID NO: 28636 - protein, 72 aa, Homo sapiens
  Payload ID: 5597
  Gene Symbol: EIF2AK1
  Gene Name: eukaryotic translation initiation factor 2-alpha kinase 1
  ENSP ID: ENSP00000392734
  MOD_RES (1)..(1): Any amino acid
XLAGLTPLGVAAVASAGTGGICWCSQRGAEGWGPTPQRRPVNLTLQMKIIEQEKEIAELKKQLNLLSQDKGA

SEQ ID NO: 28637 - protein, 164 aa, Homo sapiens
  Payload ID: 5597
  Gene Symbol: EIF2AK1
  Gene Name: eukaryotic translation initiation factor 2-alpha kinase 1
  ENSP ID: ENSP00000397590
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRDEKFHFSPSFPNQH

SEQ ID NO: 28638 - protein, 551 aa, Homo sapiens
  Payload ID: 5598
  Gene Symbol: EIF2AK2
  Gene Name: eukaryotic translation initiation factor 2-alpha kinase 2
  Uniprot ID: P19525
  ENSP ID: ENSP00000233057
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 28639 - protein, 102 aa, Homo sapiens
  Payload ID: 5598
  Gene Symbol: EIF2AK2
  Gene Name: eukaryotic translation initiation factor 2-alpha kinase 2
  ENSP ID: ENSP00000374663
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYI

SEQ ID NO: 28640 - protein, 551 aa, Homo sapiens; identical to SEQ ID NO: 28638
  Payload ID: 5598
  Gene Symbol: EIF2AK2
  Gene Name: eukaryotic translation initiation factor 2-alpha kinase 2
  Uniprot ID: P19525
  ENSP ID: ENSP00000378559

SEQ ID NO: 28641 - protein, 510 aa, Homo sapiens
  Payload ID: 5598
  Gene Symbol: EIF2AK2
  Gene Name: eukaryotic translation initiation factor 2-alpha kinase 2
  Uniprot ID: P19525
  ENSP ID: ENSP00000385014
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 28642 - protein, 141 aa, Homo sapiens
  Payload ID: 5598
  Gene Symbol: EIF2AK2
  Gene Name: eukaryotic translation initiation factor 2-alpha kinase 2
  ENSP ID: ENSP00000393921
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKE

SEQ ID NO: 28643 - protein, 1116 aa, Homo sapiens
  Payload ID: 5599
  Gene Symbol: EIF2AK3
  Gene Name: eukaryotic translation initiation factor 2-alpha kinase 3
  Uniprot ID: Q9NZJ5
  ENSP ID: ENSP00000307235
MERAISPGLLVRALLLLLLLLGLAARTVAAGRARGLPAPTAEAAFGLGAAAAPTSATRVPAAGAVAAAEVTVEDAEALPAAAGEQEPRGPEPDDETELRPRGRSLVIISTLDGRIAALDPENHGKKQWDLDVGSGSLVSSSLSKPEVFGNKMIIPSLDGALFQWDQDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFATKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 28644 - protein, 965 aa, Homo sapiens
  Payload ID: 5599
  Gene Symbol: EIF2AK3
  Gene Name: eukaryotic translation initiation factor 2-alpha kinase 3
  ENSP ID: ENSP00000408325
MIIPSLDGALFQWDQDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFATKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 28645 - protein, 956 aa, Homo sapiens
  Payload ID: 5599
  Gene Symbol: EIF2AK3
  Gene Name: eukaryotic translation initiation factor 2-alpha kinase 3
  ENSP ID: ENSP00000412076
MCYSEGGWSTSGSRLQLLITIILLKVFGNKMIIPSLDGALFQWDQDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFATKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVF

SEQ ID NO: 28646 - protein, 305 aa, Homo sapiens
  Payload ID: 5600
  Gene Symbol: EIF2B1
  Gene Name: eukaryotic translation initiation factor 2B, subunit 1 alpha, 26kDa
  Uniprot ID: Q14232
  ENSP ID: ENSP00000416250
MDDKELIEYFKSQMKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGATILTHAYSRVVLRVLEAAVAAKKRFSVYVTESQPDLSGKKMAKALCHLNVPVTVVLDAAVGYIMEKADLVIVGAEGVVENGGIINKIGTNQMAVCAKAQNKPFYVVAESFKFVRLFPLNQQDVPDKFKYKADTLKVAQTGQDLKEEHPWVDYTAPSLITLLFTDLGVLTPSAVSDELIKLYL

SEQ ID NO: 28647 - protein, 202 aa, Homo sapiens
  Payload ID: 5600
  Gene Symbol: EIF2B1
  Gene Name: eukaryotic translation initiation factor 2B, subunit 1 alpha, 26kDa
  ENSP ID: ENSP00000438060
MKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGATILTHAYSRVVLRVLEAAVAAKKRFSVYVTESQPDLSGKKMAKALCHLNVPVTVVLDAAVGLEPTRWLCVPKHRTNLSMWLQKVSSLSGSFH

SEQ ID NO: 28648 - protein, 152 aa, Homo sapiens
  Payload ID: 5600
  Gene Symbol: EIF2B1
  Gene Name: eukaryotic translation initiation factor 2B, subunit 1 alpha, 26kDa
  ENSP ID: ENSP00000443172
  MOD_RES (1)..(1): Any amino acid
XRGRLGSPGAPQQEDAMDDKELIEYFKSQMKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGALHHGESRSCHSWC

SEQ ID NO: 28649 - protein, 222 aa, Homo sapiens
  Payload ID: 5600
  Gene Symbol: EIF2B1
  Gene Name: eukaryotic translation initiation factor 2B, subunit 1 alpha, 26kDa
  Uniprot ID: Q14232
  ENSP ID: ENSP00000444183
MDDKELIEYFKSQMKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGATILTHAYSRVVLRVLEAAVAAKKRFSVYVTESQPDLSGQVPFCSVMCPAIILQSKLRITVQQDQNQNVPPACQQSALPFIVPFPAFGRKITEFAAGRSI

SEQ ID NO: 28650 - protein, 351 aa, Homo sapiens
  Payload ID: 5601
  Gene Symbol: EIF2B2
  Gene Name: eukaryotic translation initiation factor 2B, subunit 2 beta, 39kDa
  Uniprot ID: P49770
  ENSP ID: ENSP00000266126
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQGHEMAVNLSKAGIETTVMTDAAIFAVMSRVNKVIIGTKTILANGALRAVTGTHTLALAAKHHSTPLIVCAPMFKLSPQFPNEEDSFHKFVAPEEVLPFTEGDILEKVSVHCPVFDYVPPELITLFISNIGGNAPSYIYRLMSELYHPDDHVL

SEQ ID NO: 28651 - protein, 200 aa, Homo sapiens
  Payload ID: 5601
  Gene Symbol: EIF2B2
  Gene Name: eukaryotic translation initiation factor 2B, subunit 2 beta, 39kDa
  ENSP ID: ENSP00000451681
ELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQNQPFPPIAGS

SEQ ID NO: 28652 - protein, 206 aa, Homo sapiens
  Payload ID: 5601
  Gene Symbol: EIF2B2
  Gene Name: eukaryotic translation initiation factor 2B, subunit 2 beta, 39kDa
  ENSP ID: ENSP00000452311
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQQVLRQLS

SEQ ID NO: 28653 - protein, 71 aa, Homo sapiens
  Payload ID: 5601
  Gene Symbol: EIF2B2
  Gene Name: eukaryotic translation initiation factor 2B, subunit 2 beta, 39kDa
  ENSP ID: ENSP00000452582
ETTVMTDAAIFAVMSRVNKVIIGTKTILANGALRAVTGTHTLALAAKHHSTPLIVCAPMFKLSPQGLSFVT

SEQ ID NO: 28654 - protein, 452 aa, Homo sapiens
  Payload ID: 5602
  Gene Symbol: EIF2B3
  Gene Name: eukaryotic translation initiation factor 2B, subunit 3 gamma, 58kDa
  Uniprot ID: Q9NR50
  ENSP ID: ENSP00000353575
MEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGSNIQGSVICNNAVIEKGADIKDCLIGSGQRIEAKAKRVNEVIVGNDQLMEI

SEQ ID NO: 28655 - protein, 412 aa, Homo sapiens
  Payload ID: 5602
  Gene Symbol: EIF2B3
  Gene Name: eukaryotic translation initiation factor 2B, subunit 3 gamma, 58kDa
  Uniprot ID: Q9NR50
  ENSP ID: ENSP00000361257
MEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEGYVSPCTHLRQR

SEQ ID NO: 28656 - protein, 222 aa, Homo sapiens
  Payload ID: 5602
  Gene Symbol: EIF2B3
  Gene Name: eukaryotic translation initiation factor 2B, subunit 3 gamma, 58kDa
  ENSP ID: ENSP00000396985
  MOD_RES (1)..(1): Any amino acid
XVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEG

SEQ ID NO: 28657 - protein, 401 aa, Homo sapiens
  Payload ID: 5602
  Gene Symbol: EIF2B3
  Gene Name: eukaryotic translation initiation factor 2B, subunit 3 gamma, 58kDa
  Uniprot ID: Q9NR50
  ENSP ID: ENSP00000483996
MEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKTDVLVLSCDLITDVALHEVVDLFRAYDASLAMLMRKGQDSIEPVPGQKGKKKAVEQRDFIGVDSTGKRLLFMANEADLDEELVIKGSILQKHPRIRFHTGLVDAHLYCLKKYIVDFLMENGSITSIRSELIPYLVRKQFSSASSQQGQEEKEEDLKKKELKSLDIYSFIKEANTLNLAPYDACWNACRGDRWEDLSRSQVRCYVHIMKEGLCSRVSTLGLYMEANRQVPKLLSALCPEEPPVHSSAQIVSKHLVGVDSLIGPETQIGEKSSIKRSVIGSSCLIKDRVTITNCLLMNSVTVEEG

SEQ ID NO: 28658 - protein, 128 aa, Homo sapiens
  Payload ID: 5602
  Gene Symbol: EIF2B3
  Gene Name: eukaryotic translation initiation factor 2B, subunit 3 gamma, 58kDa
  ENSP ID: ENSP00000485842
MEFQAVVMAVGGGSRMTDLTSSIPKPLLPVGNKPLIWYPLNLLERVGFEEVIVVTTRDVQKALCAEFKMKMKPDIVCIPDDADMGTADSLRYIYPKLKLPKPLSLTYQERLLVHSFSQALDRCAGAEL

SEQ ID NO: 28659 - protein, 523 aa, Homo sapiens
  Payload ID: 5603
  Gene Symbol: EIF2B4
  Gene Name: eukaryotic translation initiation factor 2B, subunit 4 delta, 67kDa
  Uniprot ID: Q9UI10
  ENSP ID: ENSP00000233552
MAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 28660 - protein, 235 aa, Homo sapiens
  Payload ID: 5603
  Gene Symbol: EIF2B4
  Gene Name: eukaryotic translation initiation factor 2B, subunit 4 delta, 67kDa
  ENSP ID: ENSP00000384375
MAAVAVAVREDSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSHGATRPAVLPGPGQWLQCPVYCPASCLAAGDSGLHNTA

SEQ ID NO: 28661 - protein, 522 aa, Homo sapiens
  Payload ID: 5603
  Gene Symbol: EIF2B4
  Gene Name: eukaryotic translation initiation factor 2B, subunit 4 delta, 67kDa
  Uniprot ID: Q9UI10
  ENSP ID: ENSP00000394397
MAAVAVAVREDSGSGMKAELPPGPGAVGREMTKEEKLQLRKEKKQQKKKRKEEKGAEPETGSAVSAAQCQGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 28662 - protein, 543 aa, Homo sapiens
  Payload ID: 5603
  Gene Symbol: EIF2B4
  Gene Name: eukaryotic translation initiation factor 2B, subunit 4 delta, 67kDa
  Uniprot ID: Q9UI10
  ENSP ID: ENSP00000394869
MPTQQPAAPSTRAPKPSRSLSGSLCALFSDADSGSGMKAELPPGPGAVGREMTKEEKLQLRKEKKQQKKKRKEEKGAEPETGSAVSAAQCQGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 28663 - protein, 194 aa, Homo sapiens
  Payload ID: 5603
  Gene Symbol: EIF2B4
  Gene Name: eukaryotic translation initiation factor 2B, subunit 4 delta, 67kDa
  ENSP ID: ENSP00000406631
  MOD_RES (1)..(1): Any amino acid
XRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEACHHTHIQAPGMIIRGIKVSISCSLRILLHLGQVRTSSSH

SEQ ID NO: 28664 - protein, 12 aa, Homo sapiens
  Payload ID: 5603
  Gene Symbol: EIF2B4
  Gene Name: eukaryotic translation initiation factor 2B, subunit 4 delta, 67kDa
  ENSP ID: ENSP00000407956
MAAVAVAVREGE

SEQ ID NO: 28665 - protein, 544 aa, Homo sapiens
  Payload ID: 5603
  Gene Symbol: EIF2B4
  Gene Name: eukaryotic translation initiation factor 2B, subunit 4 delta, 67kDa
  ENSP ID: ENSP00000429323
MPTQQPAAPSTRAPKPSRSLSGSLCALFSDADSGSGMKAELPPGPGAVGREMTKEEKLQLRKEKKQQKKKRKEEKGAEPETGSAVSAAQCQVGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 28666 - protein, 520 aa, Homo sapiens
  Payload ID: 5603
  Gene Symbol: EIF2B4
  Gene Name: eukaryotic translation initiation factor 2B, subunit 4 delta, 67kDa
  ENSP ID: ENSP00000477710
MAAVAVAVREDSGSGMKAESPWAWVGREMTKEEKLQLRKEKKQQKKKRKEEKGAEPETGSAVSAAQCQGPTRELPESGIQLGTPREKVPAGRSKAELRAERRAKQEAERALKQARKGEQGGPPPKASPSTAGETPSGVKRLPEYPQVDDLLLRRLVKKPERQQVPTRKDYGSKVSLFSHLPQYSRQNSLTQFMSIPSSVIHPAMVRLGLQYSQGLVSGSNARCIALLRALQQVIQDYTTPPNEELSRDLVNKLKPYMSFLTQCRPLSASMHNAIKFLNKEITSVGSSKREEEAKSELRAAIDRYVQEKIVLAAQAISRFAYQKISNGDVILVYGCSSLVSRILQEAWTEGRRFRVVVVDSRPWLEGRHTLRSLVHAGVPASYLLIPAASYVLPEVSKVLLGAHALLANGSVMSRVGTAQLALVARAHNVPVLVCCETYKFCERVQTDAFVSNELDDPDDLQCKRGEHVALANWQNHASLRLLNLVYDVTPPELVDLVITELGMIPCSSVPVVLRVKSSDQ

SEQ ID NO: 28667 - protein, 228 aa, Homo sapiens [sequence omitted]

SEQ ID NO: 28668 - protein, 721 aa, Homo sapiens
  Payload ID: 5604
  Gene Symbol: EIF2B5
  Gene Name: eukaryotic translation initiation factor 2B, subunit 5 epsilon, 82kDa
  Uniprot ID: Q13144
  ENSP ID: ENSP00000273783
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 28669 - protein, 92 aa, Homo sapiens
  Payload ID: 5604
  Gene Symbol: EIF2B5
  Gene Name: eukaryotic translation initiation factor 2B, subunit 5 epsilon, 82kDa
  ENSP ID: ENSP00000408198
  MOD_RES (1)..(1): Any amino acid
XVAPPGVVVSRANKRSGAGPGGSGGGGARGAEEEPPPPLQAVLVADSFDRRFFPISKDQPRVLLPLANVALIDYTLEFLTATGGRGPKYHAA

SEQ ID NO: 28670 - protein, 705 aa, Homo sapiens
  Payload ID: 5604
  Gene Symbol: EIF2B5
  Gene Name: eukaryotic translation initiation factor 2B, subunit 5 epsilon, 82kDa
  ENSP ID: ENSP00000409142
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQVVC

SEQ ID NO: 28671 - protein, 107 aa, Homo sapiens
  Payload ID: 5604
  Gene Symbol: EIF2B5
  Gene Name: eukaryotic translation initiation factor 2B, subunit 5 epsilon, 82kDa
  ENSP ID: ENSP00000414775
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLL

SEQ ID NO: 28672 - protein, 584 aa, Homo sapiens
  Payload ID: 5605
  Gene Symbol: EIF2D
  Gene Name: eukaryotic translation initiation factor 2D
  Uniprot ID: P41214
  ENSP ID: ENSP00000271764
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMFSCCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVTVVRNLEAYGLDPYSVAAILQQRCQASTTVNPAPGAKDSLQVQIQGNQVHHLGWLLLEEYQLPRKHIQGLEKALKPGKKK

SEQ ID NO: 28673 - protein, 460 aa, Homo sapiens
  Payload ID: 5605
  Gene Symbol: EIF2D
  Gene Name: eukaryotic translation initiation factor 2D
  Uniprot ID: P41214
  ENSP ID: ENSP00000356081
MFAKAFRVKSNTAIKGSDRRKLRADVTTAFPTLGTDQVSELVPGKEELNIVKLYAHKGDAVTVYVSGGNPILFELEKNLYPTVYTLWSYPDLLPTFTTWPLVLEKLVGGADLMLPGLVMPPAGLPQVQKGDLCAISLVGNRAPVAIGVAAMSTAEMLTSGLKGRGFSVLHTYQDHLCPEGRQLDIKKSSYKKLSKFLQQMQQEQIIQVKELSKGVESIVAVDWKHPRITSFVIPEPSPTSQTIQEGSREQPYHPPDIKPLYCVPASMTLLFQESGHKKGSFLEGSEVRTIVINYAKKNDLVDADNKNLVRLDPILCDCILEKNEQHTVMKLPWDSLLTRCLEKLQPAYQVTLPGQEPIVKKGRICPIDITLAQRASNKKVTVVRNLEAYGLDPYSVAAILQQRCQASTTVNPAPGAKDSLQVQIQGNQVHHLGWLLLEEYQLPRKHIQGLEKALKPGKKK

SEQ ID NO: 28674 - protein, 270 aa, Homo sapiens
  Payload ID: 5605
  Gene Symbol: EIF2D
  Gene Name: eukaryotic translation initiation factor 2D
  ENSP ID: ENSP00000394685
MFAKAFRVKSNTAIKGSDRRKLRADVTTAFPTLGTDQVSELVPGKEELNIVKLYAHKGDAVTVYVSGGNPILFELEKNLYPTDLMLPGLVMPPAGLPQVQKGDLCAISLVGNRAPVAIGVAAMSTAEMLTSGLKGRGFSVLHTYQDHLWRSGNKSSPPSIAPLALDSADLSEEKGSVQMDSTLQGDMRHMTLEGEEENGEVHQAREDKSLSEAPEDTSTRGLNQDSTDSKTLQEQMDELLQQCFLHALKCRVKKADLPLLTSTFLGSHMF

SEQ ID NO: 28675 - protein, 66 aa, Homo sapiens
  Payload ID: 5605
  Gene Symbol: EIF2D
  Gene Name: eukaryotic translation initiation factor 2D
  ENSP ID: ENSP00000479327
  MOD_RES (1)..(1): Any amino acid
XLQEQMDELLQQCFLHALKCRVKKADLPLLTSTFLGSHMFSCCPEGRQLDIKKSSYKKEGELSGGQ

SEQ ID NO: 28676 - protein, 62 aa, Homo sapiens
  Payload ID: 5605
  Gene Symbol: EIF2D
  Gene Name: eukaryotic translation initiation factor 2D
  ENSP ID: ENSP00000484299
DSLLTRCLEKLQPAYQVTLPGQEPIVKKGRICPIDITLAQRASNKKITKLRLSLRNMPVVPC

SEQ ID NO: 28677 - protein, 73 aa, Homo sapiens
  Payload ID: 5605
  Gene Symbol: EIF2D
  Gene Name: eukaryotic translation initiation factor 2D
  ENSP ID: ENSP00000484590
  MOD_RES (1)..(1): Any amino acid
XVLEKLVGGADLMLPGLVMPPAGLPQPRRTTTGHKEVKLQKGRGAFWRAVRSERSSLTTPRKMTWLMQTTKIL

SEQ ID NO: 28678 - protein, 357 aa, Homo sapiens
  Payload ID: 5606
  Gene Symbol: EIF3F
  Gene Name: Eukaryotic translation initiation factor 3 subunit F
  ENSP ID: ENSP00000485772
MATPAVPVSAPPATPTPVPAAAPASVPAPTPAPAAAPVPAAAPASSSDPAAAAAATAAPGQTPASAQAPAQTPAPALPGPALPGPFPGGRVVRLHPVILASIVDSYERRNEGAARVIGTLLGTVDKHSVEVTNCFSVPHNESEDEVAVDMEFAKNMYELHKKVSPNELILGWYATGHDITEHSVLIHEYYSREAPNPIHLTVDTSLQNGRMSIKAYVSTLMGVPGRTMGVMFTPLTVKYAYYDTERIGVDLIMKTCFSPNRVIGLSSDLQQVGGASARIQDALSTVLQYAEDVLSGKVSADNTVGRFLMSLVNQVPKIVPDDFETMLNSNINDLLMVTYLANLTQSQIALNEKLVNL

SEQ ID NO: 28679 - protein, 357 aa, Homo sapiens; identical to SEQ ID NO: 28678
  Payload ID: 5606
  Gene Symbol: EIF3F
  Gene Name: Eukaryotic translation initiation factor 3 subunit F
  ENSP ID: ENSP00000486798

SEQ ID NO: 28680 - protein, 124 aa, Homo sapiens
  Payload ID: 5606
  Gene Symbol: EIF3F
  Gene Name: Eukaryotic translation initiation factor 3 subunit F
  ENSP ID: ENSP00000487000
MATPAVPVSAPPATPTPVPAAAPASVPAPTPAPAAAPVPAAAPASSSDPAAAAAATAAPGQTPASAQAPAQTPAPALPGPALPGPFPGGRVVRLHPVILASIVDSYERRNEGAARVIGTLLGGC

SEQ ID NO: 28681 - protein, 100 aa, Homo sapiens
  Payload ID: 5606
  Gene Symbol: EIF3F
  Gene Name: Eukaryotic translation initiation factor 3 subunit F
  ENSP ID: ENSP00000487359
NRVIGLSSDLQQVGGASARIQDALSTVLQYAEDVLSGKVSADNTVGRFLMSLVNQVPKIVPDDFETMLNSNINVSALPEPLLAWFLPPPQHIHSNVKRVG

SEQ ID NO: 28682 - protein, 1382 aa, Homo sapiens
  Payload ID: 5607
  Gene Symbol: EIF3A
  Gene Name: eukaryotic translation initiation factor 3, subunit A
  Uniprot ID: Q14152
  ENSP ID: ENSP00000358140
MPAYFQRPENALKRANEFLEVGKKQPALDVLYDVMKSKKHRTWQKIHEPIMLKYLELCVDLRKSHLAKEGLYQYKNICQQVNIKSLEDVVRAYLKMAEEKTEAAKEESQQMVLDIEDLDNIQTPESVLLSAVSGEDTQDRTDRLLLTPWVKFLWESYRQCLDLLRNNSRVERLYHDIAQQAFKFCLQYTRKAEFRKLCDNLRMHLSQIQRHHNQSTAINLNNPESQSMHLETRLVQLDSAISMELWQEAFKAVEDIHGLFSLSKKPPKPQLMANYYNKVSTVFWKSGNALFHASTLHRLYHLSREMRKNLTQDEMQRMSTRVLLATLSIPITPERTDIARLLDMDGIIVEKQRRLATLLGLQAPPTRIGLINDMVRFNVLQYVVPEVKDLYNWLEVEFNPLKLCERVTKVLNWVREQPEKEPELQQYVPQLQNNTILRLLQQVSQIYQSIEFSRLTSLVPFVDAFQLERAIVDAARHCDLQVRIDHTSRTLSFGSDLNYATREDAPIGPHLQSMPSEQIRNQLTAMSSVLAKALEVIKPAHILQEKEEQHQLAVTAYLKNSRKEHQRILARRQTIEERKERLESLNIQREKEELEQREAELQKVRKAEEERLRQEAKEREKERILQEHEQIKKKTVRERLEQIKKTELGAKAFKDIDIEDLEELDPDFIMAKQVEQLEKEKKELQERLKNQEKKIDYFERAKRLEEIPLIKSAYEEQRIKDMDLWEQQEEERITTMQLEREKALEHKNRMSRMLEDRDLFVMRLKAARQSVYEEKLKQFEERLAEERHNRLEERKRQRKEERRITYYREKEEEEQRRAEEQMLKEREERERAERAKREEELREYQERVKKLEEVERKKRQRELEIEERERRREEERRLGDSSLSRKDSRWGDRDSEGTWRKGPEADSEWRRGPPEKEWRRGEGRDEDRSHRRDEERPRRLGDDEDREPSLRPDDDRVPRRGMDDDRGPRRGPEEDRFSRRGADDDRPSWRNTDDDRPPRRIADEDRGNWRHADDDRPPRRGLDEDRGSWRTADEDRGPRRGMDDDRGPRRGGADDERSSWRNADDDRGPRRGLDDDRGPRRGMDDDRGPRRGMDDDRGPRRGMDDDRGPRRGLDDDRGPWRNADDDRIPRRGAEDDRGPWRNMDDDRLSRRADDDRFPRRGDDSRPGPWRPLVKPGGWREKEKAREESWGPPRESRPSEEREWDREKERDRDNQDREENDKDPERERDRERDVDREDRFRRPRDEGGWRRGPAEESSSWRDSSRRDDRDRDDRRRERDDRRDLRERRDLRDDRDRRGPPLRSEREEVSSWRRADDRKDDRVEERDPPRRVPPPALSRDRERDRDREREGEKEKASWRAEKDRESLRRTKNETDEDGWTTVRR

SEQ ID NO: 28683 - protein, 1382 aa, Homo sapiens; identical to SEQ ID NO: 28682
  Payload ID: 5607
  Gene Symbol: EIF3A
  Gene Name: eukaryotic translation initiation factor 3, subunit A
  Uniprot ID: Q14152
  ENSP ID: ENSP00000438178

SEQ ID NO: 28684 - protein, 814 aa, Homo sapiens
  Payload ID: 5608
  Gene Symbol: EIF3B
  Gene Name: eukaryotic translation initiation factor 3, subunit B
  Uniprot ID: P55884
  ENSP ID: ENSP00000354125
MQDAENVAVPEAAEERAEPGQQQPAAEPPPAEGLLRPAGPGAPEAAGTEASSEEVGIAEAGPESEVRTEPAAEAEAASGPSESPSPPAAEELPGSHAEPPVPAQGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAHWPIFKWSHDGKFFARMTLDTLSIYETPSMGLLDKKSLKISGIKDFSWSPGGNIIAFWVPEDKDIPARVTLMQLPTRQEIRVRNLFNVVDCKLHWQKNGDYLCVKVDRTPKGTQGVVTNFEIFRMREKQVPVDVVEMKETIIAFAWEPNGSKFAVLHGEAPRISVSFYHVKNNGKIELIKMFDKQQANTIFWSPQGQFVVLAGLRSMNGALAFVDTSDCTVMNIAEHYMASDVEWDPTGRYVVTSVSWWSHKVDNAYWLWTFQGRLLQKNNKDRFCQLLWRPRPPTLLSQEQIKQIKKDLKKYSKIFEQKDRLSQSKASKELVERRRTMMEDFRKYRKMAQELYMEQKNERLELRGGVDTDELDSNVDDWEEETIEFFVTEEIIPLGNQE

SEQ ID NO: 28685 - protein, 814 aa, Homo sapiens; identical to SEQ ID NO: 28684
  Payload ID: 5608
  Gene Symbol: EIF3B
  Gene Name: eukaryotic translation initiation factor 3, subunit B
  Uniprot ID: P55884
  ENSP ID: ENSP00000380206

SEQ ID NO: 28686 - protein, 302 aa, Homo sapiens
  Payload ID: 5608
  Gene Symbol: EIF3B
  Gene Name: eukaryotic translation initiation factor 3, subunit B
  ENSP ID: ENSP00000407785
MQDAENVAVPEAAEERAEPGQQQPAAEPPPAEGLLRPAGPGAPEAAGTEASSEEVGIAEAGPESEGEAPGEQARDERSDSRAQAVSEDAGGNEGRAAEAEPRALENGDADEPSFSDPEDFVDDVSEEELLGDVLKDRPQEADGIDSVIVVDNVPQVGPDRLEKLKNVIHKIFSKFGKITNDFYPEEDGKTKGYIFLEYASPAHAVDAVKNADGYKLDKQHTFRVNLFTDFDKYMTISDEWDIPEKQPFKDLGNLRYWLEEAECRDQYSVIFESGDRTSIFWNDVKDPVSIEERARWTETYVR

SEQ ID NO: 28687 - protein, 153 aa, Homo sapiens
  Payload ID: 5608
  Gene Symbol: EIF3B
  Gene Name: eukaryotic translation initiation factor 3, subunit B
  ENSP ID: ENSP00000408062
MTISDEWDIPEKQPFKDLGNLRYWLEEAECRDQYSVIFESGDRTSIFWNDVKDPVSIEERARWTETYVRWSPKGTYLATFHQRGIALWGGEKFKQIQRFSHQGVQLIDFSPCERYLVTFSPLMDTQDDPQAIIIWDILTGHKKRGFHCESSAH

SEQ ID NO: 28688 - protein, 913 aa, Homo sapiens
  Payload ID: 5609
  Gene Symbol: EIF3C
  Gene Name: eukaryotic translation initiation factor 3, subunit C
  Uniprot ID: Q99613
  ENSP ID: ENSP00000332604
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 28689 - protein, 913 aa, Homo sapiens; identical to SEQ ID NO: 28688
  Payload ID: 5609
  Gene Symbol: EIF3C
  Gene Name: eukaryotic translation initiation factor 3, subunit C
  Uniprot ID: Q99613
  ENSP ID: ENSP00000378953

SEQ ID NO: 28690 - protein, 132 aa, Homo sapiens
  Payload ID: 5609
  Gene Symbol: EIF3C
  Gene Name: eukaryotic translation initiation factor 3, subunit C
  ENSP ID: ENSP00000455277
MKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLKKKSE

SEQ ID NO: 28691 - protein, 148 aa, Homo sapiens
  Payload ID: 5609
  Gene Symbol: EIF3C
  Gene Name: eukaryotic translation initiation factor 3, subunit C
  ENSP ID: ENSP00000455278
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKY

SEQ ID NO: 28692 - protein, 903 aa, Homo sapiens
  Payload ID: 5609
  Gene Symbol: EIF3C
  Gene Name: eukaryotic translation initiation factor 3, subunit C
  Uniprot ID: Q99613
  ENSP ID: ENSP00000456416
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNEMNKNNAKALSTLRQKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 28693 - protein, 79 aa, Homo sapiens
  Payload ID: 5609
  Gene Symbol: EIF3C
  Gene Name: eukaryotic translation initiation factor 3, subunit C
  ENSP ID: ENSP00000457389
MKIRDVTKCLEEFELLGKAYGKAKSIVDKEGVPRFYIRILADLEDYLNELWEDKEGKKKMNKNNAKALSTLRQKIRKYN

SEQ ID NO: 28694 - protein, 913 aa, Homo sapiens; identical to SEQ ID NO: 28688
  Payload ID: 5609
  Gene Symbol: EIF3C
  Gene Name: eukaryotic translation initiation factor 3, subunit C
  Uniprot ID: Q99613
  ENSP ID: ENSP00000457418

SEQ ID NO: 28695 - protein, 913 aa, Homo sapiens; identical to SEQ ID NO: 28688
  Payload ID: 5609
  Gene Symbol: EIF3C
  Gene Name: eukaryotic translation initiation factor 3, subunit C
  Uniprot ID: Q99613
  ENSP ID: ENSP00000457963

SEQ ID NO: 28696 - protein, 914 aa, Homo sapiens
  Payload ID: 5610
  Gene Symbol: EIF3CL
  Gene Name: eukaryotic translation initiation factor 3, subunit C-like
  Uniprot ID: B5ME19
  ENSP ID: ENSP00000370258
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 28697 - protein, 914 aa, Homo sapiens; identical to SEQ ID NO: 28696
  Payload ID: 5610
  Gene Symbol: EIF3CL
  Gene Name: eukaryotic translation initiation factor 3, subunit C-like
  Uniprot ID: B5ME19
  ENSP ID: ENSP00000381917

SEQ ID NO: 28698 - protein, 548 aa, Homo sapiens
  Payload ID: 5611
  Gene Symbol: EIF3D
  Gene Name: eukaryotic translation initiation factor 3, subunit D
  Uniprot ID: O15371
  ENSP ID: ENSP00000216190
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQKPRDSSVEVRSDWEVKEEMDFPQLMKMRYLEVSEPQDIECCGALEYYDKAFDRITTRSEKPLRSIKRIFHTVTTTDDPVIRKLAKTQGNVFATDAILATLMSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 28699 - protein, 123 aa, Homo sapiens
  Payload ID: 5611
  Gene Symbol: EIF3D
  Gene Name: eukaryotic translation initiation factor 3, subunit D
  ENSP ID: ENSP00000385212
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILP

SEQ ID NO: 28700 - protein, 548 aa, Homo sapiens; identical to SEQ ID NO: 28698
  Payload ID: 5611
  Gene Symbol: EIF3D
  Gene Name: eukaryotic translation initiation factor 3, subunit D
  Uniprot ID: O15371
  ENSP ID: ENSP00000385812

SEQ ID NO: 28701 - protein, 269 aa, Homo sapiens
  Payload ID: 5611
  Gene Symbol: EIF3D
  Gene Name: eukaryotic translation initiation factor 3, subunit D
  ENSP ID: ENSP00000390438
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQKPRDSSVEVRSDWEVKEEMDFPQLMKMRYLEVSEPQDIECCGALEYYDKAFDRITTRSEKPLRSIKRIFHTVTTTDDPVIRKLAKTQGNVFATDAILATLMSCTRSVYSWDIVV

SEQ ID NO: 28702 - protein, 105 aa, Homo sapiens
  Payload ID: 5611
  Gene Symbol: EIF3D
  Gene Name: eukaryotic translation initiation factor 3, subunit D
  ENSP ID: ENSP00000391061
  MOD_RES (1)..(1): Any amino acid
XFDRITTRSEKPLRSIKRIFHTVTTTDDPVIRKLAKTQGNVFATDAILATLMSCTRSVYSWDIVVQRVGSKLFFDKRDNSDFALRTLSVTLCCMVSDHATLLQTS

SEQ ID NO: 28703 - protein, 173 aa, Homo sapiens
  Payload ID: 5611
  Gene Symbol: EIF3D
  Gene Name: eukaryotic translation initiation factor 3, subunit D
  ENSP ID: ENSP00000403584
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQKPRDSSVEVRSDWEVKEE

SEQ ID NO: 28704 - protein, 49 aa, Homo sapiens
  Payload ID: 5611
  Gene Symbol: EIF3D
  Gene Name: eukaryotic translation initiation factor 3, subunit D
  ENSP ID: ENSP00000487325
MKLEEGKYLILKDPNKQVIRVYSLPDGTFSSDEDEEEEEEEEEEEEAGD

SEQ ID NO: 28705 - protein, 445 aa, Homo sapiens
  Payload ID: 5612
  Gene Symbol: EIF3E
  Gene Name: eukaryotic translation initiation factor 3, subunit E
  Uniprot ID: P60228
  ENSP ID: ENSP00000220849
MAEYDLTTRIAHFLDRHLVFPLLEFLSVKEIYNEKELLQGKLDLLSDTNMVDFAMDVYKNLYSDDIPHALREKRTTVVAQLKQLQAETEPIVKMFEDPETTRQMQSTRDGRMLFDYLADKHGFRQEYLDTLYRYAKFQYECGNYSGAAEYLYFFRVLVPATDRNALSSLWGKLASEILMQNWDAAMEDLTRLKETIDNNSVSSPLQSLQQRTWLIHWSLFVFFNHPKGRDNIIDLFLYQPQYLNAIQTMCPHILRYLTTAVITNKDVRKRRQVLKDLVKVIQQESYTYKDPITEFVECLYVNFDFDGAQKKLRECESVLVNDFFLVACLEDFIENARLFIFETFCRIHQCISINMLADKLNMTPEEAERWIVNLIRNARLDAKIDSKLGHVVMGNNAVSPYQQVIEKTKSLSFRSQMLAMNIEKKLNQNSRSEAPNWATQDSGFY

SEQ ID NO: 28706 - protein, 156 aa, Homo sapiens
  Payload ID: 5612
  Gene Symbol: EIF3E
  Gene Name: eukaryotic translation initiation factor 3, subunit E
  ENSP ID: ENSP00000428170
  MOD_RES (1)..(1): Any amino acid
XLMQNWDAAMEDLTRLKETIDNNSVSSPLQSLQQRTWLIHWSLFVFFNHPKGRDNIIDLFLYQPHMLADKLNMTPEEAERWIVNLIRNARLDAKIDSKLGHVVMGNNAVSPYQQVIEKTKSLSFRSQMLAMNIEKKLNQNSRSEAPNWATQDSGFY

SEQ ID NO: 28707 - protein, 352 aa, Homo sapiens
  Payload ID: 5612
  Gene Symbol: EIF3E
  Gene Name: eukaryotic translation initiation factor 3, subunit E
  ENSP ID: ENSP00000428796
MFEDPETTRQMQSTRDGRMLFDYLADKHGFRQEYLDTLYRYAKFQYECGNYSGAAEYLYFFRVLVPATDRNALSSLWGKLASEILMQNWDAAMEDLTRLKETIDNNSVSSPLQSLQQRTWLIHWSLFVFFNHPKGRDNIIDLFLYQPQYLNAIQTMCPHILRYLTTAVITNKDVRKRRQVLKDLVKVIQQESYTYKDPITEFVECLYVNFDFDGAQKKLRECESVLVNDFFLVACLEDFIENARLFIFETFCRIHQCISINMLADKLNMTPEEAERWIVNLIRNARLDAKIDSKLGHVVMGNNAVSPYQQVIEKTKSLSFRSQMLAMNIEKKLNQNSRSEAPNWATQDSGFY

SEQ ID NO: 28708 - protein, 45 aa, Homo sapiens
  Payload ID: 5612
  Gene Symbol: EIF3E
  Gene Name: eukaryotic translation initiation factor 3, subunit E
  ENSP ID: ENSP00000429327
MAEYDLTTRIAHFLDRHLVFPLLEFLSVKEVVSAMWMEKHIGVYY

SEQ ID NO: 28709 - protein, 74 aa, Homo sapiens
  Payload ID: 5612
  Gene Symbol: EIF3E
  Gene Name: eukaryotic translation initiation factor 3, subunit E
  ENSP ID: ENSP00000429968
  MOD_RES (1)..(1): Any amino acid
XFLDRHLVFPLLEFLSVKEIYNEKELLQGKLDLLSDTNMVDFAMDVYKNLYSDDIPHGMVGCSLTTWRTSMVLG

SEQ ID NO: 28710 - protein, 171 aa, Homo sapiens
  Payload ID: 5612
  Gene Symbol: EIF3E
  Gene Name: eukaryotic translation initiation factor 3, subunit E
  ENSP ID: ENSP00000430152
  MOD_RES (1)..(1): Any amino acid
XEYDLTTRIAHFLDRHLVFPLLEFLSVKEIYNEKELLQGKLDLLSDTNMVDFAMDVYKNLYSDDIPHALREKRTTVVAQLKQLQAETEPIVKMFEDPETTRQMQSTRDGRMLFDYLADKHGFRQEYLDTLYRYAKFQYECGNYSGAAEYLYFFRVLMESCYVAQADLKLLA

SEQ ID NO: 28711 - protein, 56 aa, Homo sapiens
  Payload ID: 5612
  Gene Symbol: EIF3E
  Gene Name: eukaryotic translation initiation factor 3, subunit E
  ENSP ID: ENSP00000430649
MAEYDLTTRIAHFLDRHLVFPLLEFLSVKEERWRGFYLYTALPRKGKRWFVGTHKK

SEQ ID NO: 28712 - protein, 75 aa, Homo sapiens
  Payload ID: 5612
  Gene Symbol: EIF3E
  Gene Name: eukaryotic translation initiation factor 3, subunit E
  ENSP ID: ENSP00000430678
MVDFAMDVYKNLYSDDIPHALREKRTTVVAQLKQLQAETEPIVKMFEDPETTRQMQSTRDGRMLFDYLADKHGFR

SEQ ID NO: 28713 - protein, 75 aa, Homo sapiens
  Payload ID: 5612
  Gene Symbol: EIF3E
  Gene Name: eukaryotic translation initiation factor 3, subunit E
  ENSP ID: ENSP00000430709
MAEYDLTTRIAHFLDRHLVFPLLEFLSVKEIYNEKELLQGKLDLLSDTNMVDFAMDVYKNLYSDDIPHVLFCIFN

SEQ ID NO: 28714 - protein, 226 aa, Homo sapiens
  Payload ID: 5612
  Gene Symbol: EIF3E
  Gene Name: eukaryotic translation initiation factor 3, subunit E
  ENSP ID: ENSP00000430839
MAEYDLTTRIAHFLDRHLVFPLLEFLSVKEVPATDRNALSSLWGKLASEILMQNWDAAMEDLTRLKETIDNNSVSSPLQSLQQRTWLIHWSLFVFFNHPKGRDNIIDLFLYQPQYLNAIQTMCPHILRYLTTAVITNKDVRKRRQVLKDLVKVIQQESYTYKDPITEFVECLYVNFDFDGAQKKLRECESVLVNDFFLVACLEDFIENARLFIFETFCRIHQCISI

SEQ ID NO: 28715 - protein, 357 aa, Homo sapiens; identical to SEQ ID NO: 28678
  Payload ID: 5613
  Gene Symbol: EIF3F
  Gene Name: eukaryotic translation initiation factor 3, subunit F
  Uniprot ID: O00303
  ENSP ID: ENSP00000310040

SEQ ID NO: 28716 - protein, 357 aa, Homo sapiens; identical to SEQ ID NO: 28678
  Payload ID: 5613
  Gene Symbol: EIF3F
  Gene Name: eukaryotic translation initiation factor 3, subunit F
  Uniprot ID: O00303
  ENSP ID: ENSP00000431800

SEQ ID NO: 28717 - protein, 124 aa, Homo sapiens; identical to SEQ ID NO: 28680
  Payload ID: 5613
  Gene Symbol: EIF3F
  Gene Name: eukaryotic translation initiation factor 3, subunit F
  ENSP ID: ENSP00000432489

SEQ ID NO: 28718 - protein, 100 aa, Homo sapiens; identical to SEQ ID NO: 28681
  Payload ID: 5613
  Gene Symbol: EIF3F
  Gene Name: eukaryotic translation initiation factor 3, subunit F
  ENSP ID: ENSP00000434286

SEQ ID NO: 28719 - protein, 320 aa, Homo sapiens
  Payload ID: 5614
  Gene Symbol: EIF3G
  Gene Name: eukaryotic translation initiation factor 3, subunit G
  Uniprot ID: O75821
  ENSP ID: ENSP00000253108
MPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGNSEFDPPGPNVATTTVSDDVSMTFITSKEDLNCQEEEDPMNKLKGQKIVSCRICKGDHWTTRCPYKDTLGPMQKELAEQLGLSTGEKEKLPGELEPVQATQNKTGKYVPPSLRDGASRRGESMQPNRRADDNATIRVTNLSEDTRETDLQELFRPFGSISRIYLAKDKTTGQSKGFAFISFHRREDAARAIAGVSGFGYDHLILNVEWAKPSTN

SEQ ID NO: 28720 - protein, 262 aa, Homo sapiens
  Payload ID: 5614
  Gene Symbol: EIF3G
  Gene Name: eukaryotic translation initiation factor 3, subunit G
  ENSP ID: ENSP00000465882
MPTGDFDSKPSWADQVEEEGEDDKCVTSELLKGIPLATGDTSPEPELLPGAPLPPPKEVINGNIKTVTEYKIDEDGKKFKVRIVRTFRIETRKASKAVARRKNWKKFGNSEFDPPGPNVATTTVSDDVSMTFITSKEDLNCQEEEDPMNKLKGQKIVSCRICKGDHWTTRCPYKDTLGPMQKELAEQLGLSTGEKEKLPGELEPVQATQNKTGKYVPPSLRDGASRRGESMQPNRRADDNATIRVTNLSEDTRETDLQELFR

SEQ ID NO: 28721 - protein, 149 aa, Homo sapiens
  Payload ID: 5614
  Gene Symbol: EIF3G
  Gene Name: eukaryotic translation initiation factor 3, subunit G
  ENSP ID: ENSP00000465933
MPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKSVALSPRLKCSGTISTHCNLRLLGSSDSPASASRVAGVTELEEVRELRV

SEQ ID NO: 28722 - protein, 289 aa, Homo sapiens
  Payload ID: 5614
  Gene Symbol: EIF3G
  Gene Name: eukaryotic translation initiation factor 3, subunit G
  ENSP ID: ENSP00000466860
MPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGNSEFDPPGPNVATTTVSDDVSMTFITSKEDLNCQEEEDPMNKLKGQKIVSCRICKGDHWTTRCPYKDTLGPMQKELAEQLGLSTELEPVQATQNKTGKYVPPSLRDGASRRGESMQPNRRADDNATIRVTNLSEDTRETDLQELFRPFGSISRIYLAKDKTTGQSKGFAFISFHRREDAARAI

SEQ ID NO: 28723 - protein, 52 aa, Homo sapiens
  Payload ID: 5614
  Gene Symbol: EIF3G
  Gene Name: eukaryotic translation initiation factor 3, subunit G
  ENSP ID: ENSP00000466943
MPTGDFDSKPSWADQVEEEGEDDKCVTSELLKGIPLATGDTSPEPELLPGGE

SEQ ID NO: 28724 - protein, 118 aa, Homo sapiens
  Payload ID: 5614
  Gene Symbol: EIF3G
  Gene Name: eukaryotic translation initiation factor 3, subunit G
  ENSP ID: ENSP00000467187
TGEKEKLPGELEPVQATQNKTGKYVPPSLRDGASRRGESMQPNRREDTRETDLQELFRPFGSISRIYLAKDKTTGQSKGFAFISFHRREDAARAIAGVSGFGYDHLILNVEWAKPSTN

SEQ ID NO: 28725 - protein, 227 aa, Homo sapiens
  Payload ID: 5614
  Gene Symbol: EIF3G
  Gene Name: eukaryotic translation initiation factor 3, subunit G
  ENSP ID: ENSP00000468159
MPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKDLNCQEEEDPMNKLKGQKIVSCRICKGDHWTTRCPYKDTLGPMQKELAEQLGLSTGEKEKLPGELEPVQATQNKTGKYVPPSLRDGASRRGESMQPNRRADDNATIRVTNLSEDTRETDLQELFRPF

SEQ ID NO: 28726 - protein, 40 aa, Homo sapiens
  Payload ID: 5614
  Gene Symbol: EIF3G
  Gene Name: eukaryotic translation initiation factor 3, subunit G
  ENSP ID: ENSP00000468313
MPTGDFDSKPSWADQVEEEGEDGVIPKALPSQLGSSCPWS

SEQ ID NO: 28727 - protein, 366 aa, Homo sapiens
  Payload ID: 5615
  Gene Symbol: EIF3H
  Gene Name: eukaryotic translation initiation factor 3, subunit H
  ENSP ID: ENSP00000276682
MYSRHAQRIPPGKKMASRKEGTGSTATSSSSTAGAAGKGKGKGGSGDSAVKQVQIDGLVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCKEKDFSPEALKKANITFEYMFEEVPIVIKNSHLINVLMWELEKKSAVADKHELLSLASSNHLGKNLQLLMDRVDEMSQDIVKYNTYMRNTSKQQQQKHQYQQRRQQENMQRQSRGEPPLPEEDLSKLFKPPQPPARMDSLLIAGQINTYCQNIKEFTAQNLGKLFMAQALQEYNN

SEQ ID NO: 28728 - protein, 97 aa, Homo sapiens
  Payload ID: 5615
  Gene Symbol: EIF3H
  Gene Name: eukaryotic translation initiation factor 3, subunit H
  ENSP ID: ENSP00000427908
MYSRHAQRIPPGKKMASRKEGTGSTATSSSSTAGAAGKGKGKGGSGDSAVKQVQIDGLVVLKIIKHYQEEGQGTEVVQGVLLGLVVEDRLEITNCFP

SEQ ID NO: 28729 - protein, 244 aa, Homo sapiens
  Payload ID: 5615
  Gene Symbol: EIF3H
  Gene Name: eukaryotic translation initiation factor 3, subunit H
  ENSP ID: ENSP00000428195
MALPSISFGVICQPLEKGTSTHRRRGTGLGGKGSRIWLDTKRVRFTRDSWVVMEASQERDPSWRVQYQMEMMRSLRHVNIDHLHVGWYQSTYYGSFVTRALLDSQFSYQHAIEESVVLIYDPIKTAQGSLSLKAYRLTPKLMEVCKEKDFSPEALKKANITFEYMFEEVPIVIKNSHLINVLMWELEKKSAVADKHELLSLASSNHLGKNLQLLMDRVDEMSQDIVKYNTYMRNTSKQQQQKHQ

SEQ ID NO: 28730 - protein, 235 aa, Homo sapiens
  Payload ID: 5615
  Gene Symbol: EIF3H
  Gene Name: eukaryotic translation initiation factor 3, subunit H
  ENSP ID: ENSP00000428669
MASRKEGTGSTATSSSSTAGAAGKGKGKGGSGDSAVKQVQIDGLFSGQVSSQKPFLDPPKVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCKEKDFSPEALKKANITFEYMFEEVPIVIKNSHLINVLMWELE

SEQ ID NO: 28731 - protein, 170 aa, Homo sapiens
  Payload ID: 5615
  Gene Symbol: EIF3H
  Gene Name: eukaryotic translation initiation factor 3, subunit H
  ENSP ID: ENSP00000428885
MASRKEGTGSTATSSSSTAGAAGKGKGKGGSGDSAVKQVQIDGLVVLKIIKHYQEEGQGTEVVQGVLLGLVVEDRLEITNCFPFPQHTEDDADFDEGSFIVQHTSELRSLLLLSSIPLNVFQYQMEMMRSLRHVNIDHLHVGWYQSTYYGSFVTRALLDSQFSYQHAIEE

SEQ ID NO: 28732 - protein, 56 aa, Homo sapiens
  Payload ID: 5615
  Gene Symbol: EIF3H
  Gene Name: eukaryotic translation initiation factor 3, subunit H
  ENSP ID: ENSP00000429884
MASRKEGTGSTATSSSSTAGAAGKGKGKGGSGDSAVKQVQIDGLGNAFKYVDRKYC

SEQ ID NO: 28733 - protein, 352 aa, Homo sapiens
  Payload ID: 5615
  Gene Symbol: EIF3H
  Gene Name: eukaryotic translation initiation factor 3, subunit H
  Uniprot ID: O15372
  ENSP ID: ENSP00000429931
MASRKEGTGSTATSSSSTAGAAGKGKGKGGSGDSAVKQVQIDGLVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCKEKDFSPEALKKANITFEYMFEEVPIVIKNSHLINVLMWELEKKSAVADKHELLSLASSNHLGKNLQLLMDRVDEMSQDIVKYNTYMRNTSKQQQQKHQYQQRRQQENMQRQSRGEPPLPEEDLSKLFKPPQPPARMDSLLIAGQINTYCQNIKEFTAQNLGKLFMAQALQEYNN

SEQ ID NO: 28734 - protein, 46 aa, Homo sapiens
  Payload ID: 5615
  Gene Symbol: EIF3H
  Gene Name: eukaryotic translation initiation factor 3, subunit H
  ENSP ID: ENSP00000430926
MASRKEGTGSTATSSSSTAGAAGKGKGKGGSGDSAVKQVQIDGLFS

SEQ ID NO: 28735 - protein, 349 aa, Homo sapiens
  Payload ID: 5615
  Gene Symbol: EIF3H
  Gene Name: eukaryotic translation initiation factor 3, subunit H
  ENSP ID: ENSP00000482724
MASRKEGTGSTATSSSSTAGAAGKGKGKGGSGDSAVKQVQIDGLVIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCKEKDFSPEALKKANITFEYMFEEVPIVIKNSHLINVLMWELEKKSAVADKHELLSLASSNHLGKNLQLLMDRVDEMSQDIVKYNTYMRNTSKQQQQKHQYQQRRQQENMQRQSRGEPPLPEEDLSKLFKPPQPPARMDSLLIAGQINTYCQNIKEFTAQNLGKLFMAQALQEYNN

SEQ ID NO: 28736 - protein, 125 aa, Homo sapiens
  Payload ID: 5616
  Gene Symbol: EIF3I
  Gene Name: eukaryotic translation initiation factor 3, subunit I
  ENSP ID: ENSP00000347194
MKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCFVSFF

SEQ ID NO: 28737 - protein, 325 aa, Homo sapiens
  Payload ID: 5616
  Gene Symbol: EIF3I
  Gene Name: eukaryotic translation initiation factor 3, subunit I
  Uniprot ID: Q13347
  ENSP ID: ENSP00000362688
MKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCFVSFFDLRDPSQIDNNEPYMKIPCNDSKITSAVWGPLGECIIAGHESGELNQYSAKSGEVLVNVKEHSRQINDIQLSRDMTMFVTASKDNTAKLFDSTTLEHQKTFRTERPVNSAALSPNYDHVVLGGGQEAMDVTTTSTRIGKFEARFFHLAFEEEFGRVKGHFGPINSVAFHPDGKSYSSGGEDGYVRIHYFDPQYFEFEFEA

SEQ ID NO: 28738 - protein, 258 aa, Homo sapiens
  Payload ID: 5617
  Gene Symbol: EIF3J
  Gene Name: eukaryotic translation initiation factor 3, subunit J
  Uniprot ID: O75822
  ENSP ID: ENSP00000261868
MAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 28739 - protein, 209 aa, Homo sapiens
  Payload ID: 5617
  Gene Symbol: EIF3J
  Gene Name: eukaryotic translation initiation factor 3, subunit J
  Uniprot ID: O75822
  ENSP ID: ENSP00000414548
MAAAAAAAGDSDSWDADAFSVEDPVRKVGGGGTAGGDRWEGEDEDEDVKLEEPEEPKVLTPEEQLADKLRLKKLQEESDLELAKETFGVNNAVYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 28740 - protein, 204 aa, Homo sapiens
  Payload ID: 5617
  Gene Symbol: EIF3J
  Gene Name: eukaryotic translation initiation factor 3, subunit J
  Uniprot ID: O75822
  ENSP ID: ENSP00000440221
MAAAAAAAGDSDSWDADAFSVEDPVRKVGGGGTAGGDRWEGEDEDEDVKDNWDDDDDEKKEEAEVKPEVKISEKKKIAEKIKEKERQQKKRQEEIKKRLEEPEEPKVLTPEEQLADKLRLKKLQEESDLELAKETFVEIDDLKKITNSLTVLCSEKQKQEKQSKAKKKKKGVVPGGGLKATMKDDLADYGGYDGGYVQDYEDFM

SEQ ID NO: 28741 - protein, 106 aa, Homo sapiens
  Payload ID: 5617
  Gene Symbol: EIF3J
  Gene Name: eukaryotic translation initiation factor 3, subunit J
  ENSP ID: ENSP00000443563
  MOD_RES (1)..(1): Any amino acid
XLQEESDLELAKETFGVNNAVYGIDAMNPSSRDDFTEFGKLLKDKITQYEKSLYYASFLEVLVRDVCISLEIDDLKKITNSLTVLCSEKQKQEKVRASCVGKWVLN

SEQ ID NO: 28742 - protein, 117 aa, Homo sapiens
  Payload ID: 5617
  Gene Symbol: EIF3J
  Gene Name: eukaryotic translation initiation factor 3, subunit J
  ENSP ID: ENSP00000453282
  MOD_RES (1)..(1): Any amino acid
XYGIDAMNPSSRDDFTEFGKLLKDKITQYEKSLYYASFLEVLVRDVCISLEIDDLKKITNSLTVLCSEKQKQEKQSKAKKKKKGVVPGGGLKATMKDDLADYGGYDGGYVQDYEDFM

SEQ ID NO: 28743 - protein, 218 aa, Homo sapiens
  Payload ID: 5618
  Gene Symbol: EIF3K
  Gene Name: eukaryotic translation initiation factor 3, subunit K
  Uniprot ID: Q9UBQ5
  ENSP ID: ENSP00000248342
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWSADESGQIFICSQEESIKPKNIVEKIDFDSVSSIMASSQ

SEQ ID NO: 28744 - protein, 211 aa, Homo sapiens
  Payload ID: 5618
  Gene Symbol: EIF3K
  Gene Name: eukaryotic translation initiation factor 3, subunit K
  Uniprot ID: Q9UBQ5
  ENSP ID: ENSP00000438145
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWSADESGQIFICSQEESIKPKNIVEKIDFDSEW

SEQ ID NO: 28745 - protein, 124 aa, Homo sapiens
  Payload ID: 5618
  Gene Symbol: EIF3K
  Gene Name: eukaryotic translation initiation factor 3, subunit K
  ENSP ID: ENSP00000440999
MIDQAHQEERPIRQILYLGDLLETCHFQAFWQALDENMDLLEGITGFEDSVRKFICHVVGITYQHIDRWLLAEMLGDLSDSQLKVWMSKYGWSADESGQIFICSQEESIKPKNIVEKIDFDSEW

SEQ ID NO: 28746 - protein, 131 aa, Homo sapiens
  Payload ID: 5618
  Gene Symbol: EIF3K
  Gene Name: eukaryotic translation initiation factor 3, subunit K
  ENSP ID: ENSP00000465460
MIDQAHQEERPIRQILYLGDLLETCHFQAFWQALDENMDLLEGITGFEDSVRKFICHVVGITYQHIDRWLLAEMLGDLSDSQLKVWMSKYGWSADESGQIFICSQEESIKPKNIVEKIDFDSVSSIMASSQ

SEQ ID NO: 28747 - protein, 170 aa, Homo sapiens
  Payload ID: 5618
  Gene Symbol: EIF3K
  Gene Name: eukaryotic translation initiation factor 3, subunit K
  ENSP ID: ENSP00000467895
MAMFEQMRANVGKLLKGIDRYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWSADESGQIFICSQEESIKPKNIVE

SEQ ID NO: 28748 - protein, 192 aa, Homo sapiens
  Payload ID: 5618
  Gene Symbol: EIF3K
  Gene Name: eukaryotic translation initiation factor 3, subunit K
  ENSP ID: ENSP00000468231
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWQALDENMDLLEGITGFEDSVRKYSQLKVWMSKYGWSADESGQIFICSQEESIKPKNIVEKIDFDSVSSIMASSQ

SEQ ID NO: 28749 - protein, 137 aa, Homo sapiens
  Payload ID: 5618
  Gene Symbol: EIF3K
  Gene Name: eukaryotic translation initiation factor 3, subunit K
  ENSP ID: ENSP00000468525
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYLGDLLETCHFQAFWVCPASWPPPSNFRCLIKMC

SEQ ID NO: 28750 - protein, 185 aa, Homo sapiens
  Payload ID: 5618
  Gene Symbol: EIF3K
  Gene Name: eukaryotic translation initiation factor 3, subunit K
  ENSP ID: ENSP00000479334
MAMFEQMRANVGKLLKGIDRYQFNPAFFQTTVTAQILLKALTNLPHTDFTLCKCMIDQAHQEERPIRQILYLGDLLETCHFQAFWQALDENMDLLEGITGFEDSVRKFICHVVGITYQHIDRWLLAEMLGDLSDSQLKVWMSKYGWSADESGQIFICSQEESIKPKNIVEKIDFDSVSSIMASSQ

SEQ ID NO: 28751 - protein, 185 aa, Homo sapiens; identical to SEQ ID NO: 28750
  Payload ID: 5618
  Gene Symbol: EIF3K
  Gene Name: eukaryotic translation initiation factor 3, subunit K
  ENSP ID: ENSP00000488955

SEQ ID NO: 28752 - protein, 192 aa, Homo sapiens; identical to SEQ ID NO: 28748
  Payload ID: 5618
  Gene Symbol: EIF3K
  Gene Name: eukaryotic translation initiation factor 3, subunit K
  ENSP ID: ENSP00000488959

SEQ ID NO: 28753 - protein, 124 aa, Homo sapiens; identical to SEQ ID NO: 28745
  Payload ID: 5618
  Gene Symbol: EIF3K
  Gene Name: eukaryotic translation initiation factor 3, subunit K
  ENSP ID: ENSP00000489153

SEQ ID NO: 28754 - protein, 211 aa, Homo sapiens; identical to SEQ ID NO: 28744
  Payload ID: 5618
  Gene Symbol: EIF3K
  Gene Name: eukaryotic translation initiation factor 3, subunit K
  ENSP ID: ENSP00000489379

SEQ ID NO: 28755 - protein, 218 aa, Homo sapiens; identical to SEQ ID NO: 28743
  Payload ID: 5618
  Gene Symbol: EIF3K
  Gene Name: eukaryotic translation initiation factor 3, subunit K
  ENSP ID: ENSP00000489438

SEQ ID NO: 28756 - protein, 170 aa, Homo sapiens; identical to SEQ ID NO: 28747
  Payload ID: 5618
  Gene Symbol: EIF3K
  Gene Name: eukaryotic translation initiation factor 3, subunit K
  ENSP ID: ENSP00000489493

SEQ ID NO: 28757 - protein, 131 aa, Homo sapiens; identical to SEQ ID NO: 28746
  Payload ID: 5618
  Gene Symbol: EIF3K
  Gene Name: eukaryotic translation initiation factor 3, subunit K
  ENSP ID: ENSP00000489565

SEQ ID NO: 28758 - protein, 137 aa, Homo sapiens; identical to SEQ ID NO: 28749
  Payload ID: 5618
  Gene Symbol: EIF3K
  Gene Name: eukaryotic translation initiation factor 3, subunit K
  ENSP ID: ENSP00000489590

SEQ ID NO: 28759 - protein, 516 aa, Homo sapiens
  Payload ID: 5619
  Gene Symbol: EIF3L
  Gene Name: eukaryotic translation initiation factor 3, subunit L
  Uniprot ID: Q9Y262
  ENSP ID: ENSP00000371099
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSFQSFSQYRCKTAKKSEEEIDFLRSNPKIWNVHSVLNVLHSLVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 28760 - protein, 466 aa, Homo sapiens
  Payload ID: 5619
  Gene Symbol: EIF3L
  Gene Name: eukaryotic translation initiation factor 3, subunit L
  ENSP ID: ENSP00000384634
MSYRPVVSPVMSLTRRCMRSRTSMRTDAVFLILYKELYYRHIYAKVSGGPSLEQRFESYYNYCNLFNYILNADGPAPLELPNQWLWDIIDEFIYQFQSFSQYRCKTAKKSEEEIDFLRSNPKIWNVHSVLNVLHSLVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 28761 - protein, 150 aa, Homo sapiens
  Payload ID: 5619
  Gene Symbol: EIF3L
  Gene Name: eukaryotic translation initiation factor 3, subunit L
  ENSP ID: ENSP00000390271
MHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGPSLEQRFESYYNYCNLFNYILNADGPA

SEQ ID NO: 28762 - protein, 183 aa, Homo sapiens
  Payload ID: 5619
  Gene Symbol: EIF3L
  Gene Name: eukaryotic translation initiation factor 3, subunit L
  ENSP ID: ENSP00000393822
MSYPADDYESEAAYDPYAYPSDYDMHTETRFRRVVQAGLELLTSGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGPSLEQRFESYYNYCNLFNY

SEQ ID NO: 28763 - protein, 40 aa, Homo sapiens
  Payload ID: 5619
  Gene Symbol: EIF3L
  Gene Name: eukaryotic translation initiation factor 3, subunit L
  ENSP ID: ENSP00000398176
FPAVLASEAAMSYPADDYESEEIQSRTLLMNVSMNSKPIR

SEQ ID NO: 28764 - protein, 127 aa, Homo sapiens
  Payload ID: 5619
  Gene Symbol: EIF3L
  Gene Name: eukaryotic translation initiation factor 3, subunit L
  ENSP ID: ENSP00000410576
ISLFPAVLASEAAMSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENRYGLLAERASFWVGLAW

SEQ ID NO: 28765 - protein, 109 aa, Homo sapiens
  Payload ID: 5619
  Gene Symbol: EIF3L
  Gene Name: eukaryotic translation initiation factor 3, subunit L
  ENSP ID: ENSP00000412349
QLLVFKHKMKNLVWTSGISALDGEFQSASEVDFYIDKDMIHIADTKVARRYGDFFIRQIHKFEEMESCAVTHAGVQRRDLSSLQPLPPGFKRVSLLSLPHSWNYSLIEP

SEQ ID NO: 28766 - protein, 607 aa, Homo sapiens
  Payload ID: 5619
  Gene Symbol: EIF3L
  Gene Name: eukaryotic translation initiation factor 3, subunit L
  ENSP ID: ENSP00000416892
MARGLGKASGFPAGPSGAELPASGRRRGPLISLFPAVLASEAAMSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGPSLEQRFESYYNYCNLFNYILNADGPAPLELPNQWLWDIIDEFIYQFQSFSQYRCKTAKKSEEEIDFLRSNPKIWNVHSVLNVLHSLVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 28767 - protein, 564 aa, Homo sapiens
  Payload ID: 5619
  Gene Symbol: EIF3L
  Gene Name: eukaryotic translation initiation factor 3, subunit L
  Uniprot ID: Q9Y262
  ENSP ID: ENSP00000485663
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGPSLEQRFESYYNYCNLFNYILNADGPAPLELPNQWLWDIIDEFIYQFQSFSQYRCKTAKKSEEEIDFLRSNPKIWNVHSVLNVLHSLVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 28768 - protein, 191 aa, Homo sapiens
  Payload ID: 5620
  Gene Symbol: EIF3M
  Gene Name: eukaryotic translation initiation factor 3, subunit M
  ENSP ID: ENSP00000319910
MNSVVSLLLILEPDKQEALIESLCEKLVKFREGERPSLRLQLLSNLFHGMDKNTPVRYTVYCSLIKVAASCGAIQYIPTELDQVRKWISDWNLTTEKKHTLLRLLYEALVDCKKSDAASKVMVELLGSYTEDNASQARVDAHRCIVRALKDPNAFLFDHLLTLKPVKFLEGELIHDLLTIFVSAKLASYVK

SEQ ID NO: 28769 - protein, 220 aa, Homo sapiens
  Payload ID: 5620
  Gene Symbol: EIF3M
  Gene Name: eukaryotic translation initiation factor 3, subunit M
  ENSP ID: ENSP00000432139
KKHTLLRLLYEALVDCKKSDAASKVMVELLGSYTEDNASQARVDAHRCIVRALKDPNAFLFDHLLTLKPVKFLEGELIHDLLTIFVSAKLASYVKFYQNNKDFIDSLGLLHEQNMAKMRLLTFMGMAVENKEISFDTMQQELQIGADDVEAFVIDAVRTKMVYCKIDQTQRKVVVSCSGELEGLGSICHSTHRTFGKQQWQQLYDTLNAWKQNLNKVKNS

SEQ ID NO: 28770 - protein, 59 aa, Homo sapiens
  Payload ID: 5620
  Gene Symbol: EIF3M
  Gene Name: eukaryotic translation initiation factor 3, subunit M
  ENSP ID: ENSP00000432286
MSVPAFIDISEEDQAAELRAYLKSKGAEISEENSEGGLHVDLAQIIEACDVCLKEDDKG

SEQ ID NO: 28771 - protein, 102 aa, Homo sapiens
  Payload ID: 5620
  Gene Symbol: EIF3M
  Gene Name: eukaryotic translation initiation factor 3, subunit M
  ENSP ID: ENSP00000432891
MNSVVSLLLILEPDKQEALIESLCEKLVKFREGERPSLRLQLLSNLFHGMDKNTPVRYTVYCSLIKVAASCGAIQYIPTELDQVRKWISDWNLTTEKKHTLL

SEQ ID NO: 28772 - protein, 74 aa, Homo sapiens
  Payload ID: 5620
  Gene Symbol: EIF3M
  Gene Name: eukaryotic translation initiation factor 3, subunit M
  ENSP ID: ENSP00000434080
MSVPAFIDISEEDQVRKWISDWNLTTEKKHTLLRLLYEALVDCKKSDAASKVMVELLGSYTEDNASQARVDAHR

SEQ ID NO: 28773 - protein, 123 aa, Homo sapiens
  Payload ID: 5620
  Gene Symbol: EIF3M
  Gene Name: eukaryotic translation initiation factor 3, subunit M
  ENSP ID: ENSP00000435501
MSVPAFIDISEEDQAAELRAYLKSKGAEISEENSEGGLHVDLAQIIEACDVCLKEDDKDVESVMNSVVSLLLILEPDKQEALIESLCEKLVKFREGERPSLRLQLLENGFLTGISPLKKSTPF

SEQ ID NO: 28774 - protein, 30 aa, Homo sapiens
  Payload ID: 5620
  Gene Symbol: EIF3M
  Gene Name: eukaryotic translation initiation factor 3, subunit M
  ENSP ID: ENSP00000435834
MSVPAFIDISEEDQELRFQKRTRKVDFMLI

SEQ ID NO: 28775 - protein, 374 aa, Homo sapiens
  Payload ID: 5620
  Gene Symbol: EIF3M
  Gene Name: eukaryotic translation initiation factor 3, subunit M
  Uniprot ID: Q7L2H7
  ENSP ID: ENSP00000436049
MSVPAFIDISEEDQAAELRAYLKSKGAEISEENSEGGLHVDLAQIIEACDVCLKEDDKDVESVMNSVVSLLLILEPDKQEALIESLCEKLVKFREGERPSLRLQLLSNLFHGMDKNTPVRYTVYCSLIKVAASCGAIQYIPTELDQVRKWISDWNLTTEKKHTLLRLLYEALVDCKKSDAASKVMVELLGSYTEDNASQARVDAHRCIVRALKDPNAFLFDHLLTLKPVKFLEGELIHDLLTIFVSAKLASYVKFYQNNKDFIDSLGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 28776 - protein, 242 aa, Homo sapiens
  Payload ID: 5620
  Gene Symbol: EIF3M
  Gene Name: eukaryotic translation initiation factor 3, subunit M
  Uniprot ID: Q7L2H7
  ENSP ID: ENSP00000436787
MSVPAFIDISEEDQVRKWISDWNLTTEKKHTLLRLLYEALVDCKKSDAASKVMVELLGSYTEDNASQARVDAHRCIVRALKDPNAFLFDHLLTLKPVKFLEGELIHDLLTIFVSAKLASYVKFYQNNKDFIDSLGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 28777 - protein, 1599 aa, Homo sapiens
  Payload ID: 5621
  Gene Symbol: EIF4G1
  Gene Name: eukaryotic translation initiation factor 4 gamma, 1
  Uniprot ID: Q04637
  ENSP ID: ENSP00000316879
MNKAPQSTGPPPAPSPGLPQPAFPPGQTAPVVFSTPQATQMNTPSQPRQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPTPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28778 - protein, 1435 aa, Homo sapiens
  Payload ID: 5621
  Gene Symbol: EIF4G1
  Gene Name: eukaryotic translation initiation factor 4 gamma, 1
  Uniprot ID: Q04637
  ENSP ID: ENSP00000317600
MNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28779 - protein, 1395 aa, Homo sapiens
  Payload ID: 5621
  Gene Symbol: EIF4G1
  Gene Name: eukaryotic translation initiation factor 4 gamma, 1
  ENSP ID: ENSP00000323737
MSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPQAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTENASKGSLTSFLRRPFQSPTSLWPMQHVPLPHGAESAHYGKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPRPLTRSIRRLRWKTSRAHQSAAAHPRAVTSVGAVLQALPSAVDFPLWMMVANTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERVNGEGTVGTGLIVRTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEEGATGALRLQALVVTLEQPPNLLRMFFDALYDEDVVKEDAFYSWESSKDPAEQQGKGVALKSVTAFFKWLREAGGV

SEQ ID NO: 28780 - protein, 1606 aa, Homo sapiens
  Payload ID: 5621
  Gene Symbol: EIF4G1
  Gene Name: eukaryotic translation initiation factor 4 gamma, 1
  Uniprot ID: Q04637
  ENSP ID: ENSP00000338020
MNKAPQSTGPPPAPSPGLPQPAFPPGQTAPVVFSTPQATQMNTPSQPRQGGFRSLQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPTPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28781 - protein, 1600 aa, Homo sapiens
  Payload ID: 5621
  Gene Symbol: EIF4G1
  Gene Name: eukaryotic translation initiation factor 4 gamma, 1
  Uniprot ID: Q04637
  ENSP ID: ENSP00000343450
MNKAPQSTGPPPAPSPGLPQPAFPPGQTAPVVFSTPQATQMNTPSQPRQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPTPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPQAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28782 - protein, 1606 aa, Homo sapiens; identical to SEQ ID NO: 28780
  Payload ID: 5621
  Gene Symbol: EIF4G1
  Gene Name: eukaryotic translation initiation factor 4 gamma, 1
  Uniprot ID: Q04637
  ENSP ID: ENSP00000371767

SEQ ID NO: 28783 - protein, 1512 aa, Homo sapiens
  Payload ID: 5621
  Gene Symbol: EIF4G1
  Gene Name: eukaryotic translation initiation factor 4 gamma, 1
  Uniprot ID: Q04637
  ENSP ID: ENSP00000376320
MMIPSQISYPASQGAYYIPGQGRSTYVVPTQQYPVQPGAPGFYPGASPTEFGTYAGAYYPAQGVQQFPTGVAPTPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28784 - protein, 71 aa, Homo sapiens
  Payload ID: 5621
  Gene Symbol: EIF4G1
  Gene Name: eukaryotic translation initiation factor 4 gamma, 1
  ENSP ID: ENSP00000390755
MNKAPQSTGPPPAPSPGLPQPAFPPGQTAPVVFSTPQATQMNTPSQPRQLAPTIQPKGCSSFPLAWPPPQF

SEQ ID NO: 28785 - protein, 833 aa, Homo sapiens
  Payload ID: 5621
  Gene Symbol: EIF4G1
  Gene Name: eukaryotic translation initiation factor 4 gamma, 1
  ENSP ID: ENSP00000391412
MNKAPQSTGPPPAPSPGLPQPAFPPGQTAPVVFSTPQATQMNTPSQPRQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPTPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPQAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEK

SEQ ID NO: 28786 - protein, 1559 aa, Homo sapiens
  Payload ID: 5621
  Gene Symbol: EIF4G1
  Gene Name: eukaryotic translation initiation factor 4 gamma, 1
  Uniprot ID: Q04637
  ENSP ID: ENSP00000391935
MNTPSQPRQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPTPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28787 - protein, 226 aa, Homo sapiens
  Payload ID: 5621
  Gene Symbol: EIF4G1
  Gene Name: eukaryotic translation initiation factor 4 gamma, 1
  ENSP ID: ENSP00000392908
  MOD_RES (1)..(1): Any amino acid
XKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKVGPGSIDSNNQLFAPGGRLSWGKGSSGGSGAKPSDAASEAARPATSTLNRFSALQQAVPTESTDNRRVVQRSSLSRERGEKAGDRGDRLERSERGGDRGD

SEQ ID NO: 28788 - protein, 1560 aa, Homo sapiens
  Payload ID: 5621
  Gene Symbol: EIF4G1
  Gene Name: eukaryotic translation initiation factor 4 gamma, 1
  ENSP ID: ENSP00000395974
MNTPSQPRQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPTPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPQAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28789 - protein, 180 aa, Homo sapiens
  Payload ID: 5621
  Gene Symbol: EIF4G1
  Gene Name: eukaryotic translation initiation factor 4 gamma, 1
  ENSP ID: ENSP00000396888
  MOD_RES (1)..(1): Any amino acid
XLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIENLGIICFSHTGQPE

SEQ ID NO: 28790 - protein, 757 aa, Homo sapiens
  Payload ID: 5621
  Gene Symbol: EIF4G1
  Gene Name: eukaryotic translation initiation factor 4 gamma, 1
  ENSP ID: ENSP00000398145
MNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVV

SEQ ID NO: 28791 - protein, 1436 aa, Homo sapiens
  Payload ID: 5621
  Gene Symbol: EIF4G1
  Gene Name: eukaryotic translation initiation factor 4 gamma, 1
  ENSP ID: ENSP00000399858
MNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPQAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28792 - protein, 285 aa, Homo sapiens
  Payload ID: 5621
  Gene Symbol: EIF4G1
  Gene Name: eukaryotic translation initiation factor 4 gamma, 1
  ENSP ID: ENSP00000399969
MSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGE

SEQ ID NO: 28793 - protein, 50 aa, Homo sapiens
  Payload ID: 5621
  Gene Symbol: EIF4G1
  Gene Name: eukaryotic translation initiation factor 4 gamma, 1
  ENSP ID: ENSP00000400351
MNQPPQIAPKRERKTIRIRDPNQGGKDITEEIMSGARTASTPTPPQAELK

SEQ ID NO: 28794 - protein, 903 aa, Homo sapiens
  Payload ID: 5621
  Gene Symbol: EIF4G1
  Gene Name: eukaryotic translation initiation factor 4 gamma, 1
  ENSP ID: ENSP00000403269
MNKAPQSTGPPPAPSPGLPQPAFPPGQTAPVVFSTPQATQMNTPSQPRQGRSTYVVPTQQYPVQPGAPGFYPGASPTEFGTYAGAYYPAQGVQQFPTGVAPTPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQM

SEQ ID NO: 28795 - protein, 1403 aa, Homo sapiens
  Payload ID: 5621
  Gene Symbol: EIF4G1
  Gene Name: eukaryotic translation initiation factor 4 gamma, 1
  Uniprot ID: Q04637
  ENSP ID: ENSP00000404754
MSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28796 - protein, 143 aa, Homo sapiens
  Payload ID: 5621
  Gene Symbol: EIF4G1
  Gene Name: eukaryotic translation initiation factor 4 gamma, 1
  ENSP ID: ENSP00000407240
MNKAPQSTGPPPAPSPGLPQPAFPPGQTAPVVFSTPQATQMNTPSQPRQHFYPSRAQPPSSAASRVQSAAPARPGPAAHVYPAGSQVMMIPSQISYPASQGAYYIPGQYPVQPGAPGFYPGASPTEFGTYAGAYYPAQGVQQF

SEQ ID NO: 28797 - protein, 127 aa, Homo sapiens
  Payload ID: 5621
  Gene Symbol: EIF4G1
  Gene Name: eukaryotic translation initiation factor 4 gamma, 1
  ENSP ID: ENSP00000407244
MSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEP

SEQ ID NO: 28798 - protein, 1513 aa, Homo sapiens
  Payload ID: 5621
  Gene Symbol: EIF4G1
  Gene Name: eukaryotic translation initiation factor 4 gamma, 1
  ENSP ID: ENSP00000407682
MMIPSQISYPASQGAYYIPGQGRSTYVVPTQQYPVQPGAPGFYPGASPTEFGTYAGAYYPAQGVQQFPTGVAPTPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPQAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28799 - protein, 163 aa, Homo sapiens
  Payload ID: 5621
  Gene Symbol: EIF4G1
  Gene Name: eukaryotic translation initiation factor 4 gamma, 1
  ENSP ID: ENSP00000409545
MSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIH

SEQ ID NO: 28800 - protein, 92 aa, Homo sapiens
  Payload ID: 5621
  Gene Symbol: EIF4G1
  Gene Name: eukaryotic translation initiation factor 4 gamma, 1
  ENSP ID: ENSP00000411214
MMIPSQISYPASQGAYYIPGQGRSTYVVPTQQYPVQPGAPGFYPGASPTEFGTYAGAYYPAQGVQQFPTGVAPTPVLMNQPPQIAPKRERKT

SEQ ID NO: 28801 - protein, 143 aa, Homo sapiens
  Payload ID: 5621
  Gene Symbol: EIF4G1
  Gene Name: eukaryotic translation initiation factor 4 gamma, 1
  ENSP ID: ENSP00000411707
MSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESE

SEQ ID NO: 28802 - protein, 1404 aa, Homo sapiens
  Payload ID: 5621
  Gene Symbol: EIF4G1
  Gene Name: eukaryotic translation initiation factor 4 gamma, 1
  Uniprot ID: Q04637
  ENSP ID: ENSP00000411826
MSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPQAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28803 - protein, 869 aa, Homo sapiens
  Payload ID: 5621
  Gene Symbol: EIF4G1
  Gene Name: eukaryotic translation initiation factor 4 gamma, 1
  ENSP ID: ENSP00000413159
MNKAPQSTGPPPAPSPGLPQPAFPPGQTAPVVFSTPQATQMNTPSQPRQGGFRSLQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPTPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPQAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVF

SEQ ID NO: 28804 - protein, 87 aa, Homo sapiens
  Payload ID: 5621
  Gene Symbol: EIF4G1
  Gene Name: eukaryotic translation initiation factor 4 gamma, 1
  ENSP ID: ENSP00000415842
MNTPSQPRQHFYPSRAQPPSSAASRVQSAAPARPGPAAHVYPAGSQVMMIPSQISYPASQGAYYIPGQGRSTYVVPTQQYPVQPGAP

SEQ ID NO: 28805 - protein, 160 aa, Homo sapiens
  Payload ID: 5621
  Gene Symbol: EIF4G1
  Gene Name: eukaryotic translation initiation factor 4 gamma, 1
  ENSP ID: ENSP00000415943
MNTPSQPRQHFYPSRAQPPSSAASRVQSAAPARPGPAAHVYPAGSQVMMIPSQISYPASQGAYYIPGQQYPVQPGAPGFYPGASPTEFGTYAGAYYPAQGVQQFPTGVAPTPVLMNQPPQIAPKRERKTIRIRDPNQGGKDITEEIMSGARTASTPTPPQ

SEQ ID NO: 28806 - protein, 1606 aa, Homo sapiens; identical to SEQ ID NO: 28780
  Payload ID: 5621
  Gene Symbol: EIF4G1
  Gene Name: eukaryotic translation initiation factor 4 gamma, 1
  Uniprot ID: Q04637
  ENSP ID: ENSP00000416255

SEQ ID NO: 28807 - protein, 907 aa, Homo sapiens
  Payload ID: 5622
  Gene Symbol: EIF4G2
  Gene Name: eukaryotic translation initiation factor 4 gamma, 2
  Uniprot ID: P78344
  ENSP ID: ENSP00000340281
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 28808 - protein, 869 aa, Homo sapiens
  Payload ID: 5622
  Gene Symbol: EIF4G2
  Gene Name: eukaryotic translation initiation factor 4 gamma, 2
  ENSP ID: ENSP00000379778
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQVNQWLTWLETAEEEESEEEAD

SEQ ID NO: 28809 - protein, 129 aa, Homo sapiens
  Payload ID: 5622
  Gene Symbol: EIF4G2
  Gene Name: eukaryotic translation initiation factor 4 gamma, 2
  ENSP ID: ENSP00000431511
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYS

SEQ ID NO: 28810 - protein, 444 aa, Homo sapiens
  Payload ID: 5622
  Gene Symbol: EIF4G2
  Gene Name: eukaryotic translation initiation factor 4 gamma, 2
  ENSP ID: ENSP00000431583
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQISLRPAQSFLM

SEQ ID NO: 28811 - protein, 282 aa, Homo sapiens
  Payload ID: 5622
  Gene Symbol: EIF4G2
  Gene Name: eukaryotic translation initiation factor 4 gamma, 2
  ENSP ID: ENSP00000433121
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQLKDMGEDLECLCQIMRTVGPRLDHERAKSLMDQYFARMC

SEQ ID NO: 28812 - protein, 84 aa, Homo sapiens
  Payload ID: 5622
  Gene Symbol: EIF4G2
  Gene Name: eukaryotic translation initiation factor 4 gamma, 2
  ENSP ID: ENSP00000433217
VESAIAEGGASRFSASSGGGGSRGAPQHYPKTAGNSEFLGKTPGQNAQKWIPARSTRRDDNSAANNSANEKERHDAIFRKVRGI

SEQ ID NO: 28813 - protein, 116 aa, Homo sapiens
  Payload ID: 5622
  Gene Symbol: EIF4G2
  Gene Name: eukaryotic translation initiation factor 4 gamma, 2
  ENSP ID: ENSP00000433335
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVIL

SEQ ID NO: 28814 - protein, 907 aa, Homo sapiens; identical to SEQ ID NO: 28807
  Payload ID: 5622
  Gene Symbol: EIF4G2
  Gene Name: eukaryotic translation initiation factor 4 gamma, 2
  ENSP ID: ENSP00000433371

SEQ ID NO: 28815 - protein, 185 aa, Homo sapiens
  Payload ID: 5622
  Gene Symbol: EIF4G2
  Gene Name: eukaryotic translation initiation factor 4 gamma, 2
  ENSP ID: ENSP00000433561
MIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELLAKLQDREWLTELFQQSKVNMQKML

SEQ ID NO: 28816 - protein, 907 aa, Homo sapiens; identical to SEQ ID NO: 28807
  Payload ID: 5622
  Gene Symbol: EIF4G2
  Gene Name: eukaryotic translation initiation factor 4 gamma, 2
  ENSP ID: ENSP00000433664

SEQ ID NO: 28817 - protein, 234 aa, Homo sapiens
  Payload ID: 5622
  Gene Symbol: EIF4G2
  Gene Name: eukaryotic translation initiation factor 4 gamma, 2
  ENSP ID: ENSP00000434815
ISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQ

SEQ ID NO: 28818 - protein, 88 aa, Homo sapiens
  Payload ID: 5622
  Gene Symbol: EIF4G2
  Gene Name: eukaryotic translation initiation factor 4 gamma, 2
  ENSP ID: ENSP00000434940
VEKRHDAIFRKVRGILNKLTPEKFDKLCLELLNVGVESKLILKGVILLIVDKALEEPKYSSLYAQLCLRLAEDAPNFDGPAAEGQPGQ

SEQ ID NO: 28819 - protein, 46 aa, Homo sapiens
  Payload ID: 5622
  Gene Symbol: EIF4G2
  Gene Name: eukaryotic translation initiation factor 4 gamma, 2
  ENSP ID: ENSP00000435220
VESAIAEGGASRFRNGFLHEALDEMTTPQQTTPQTKKNDMMQSSGK

SEQ ID NO: 28820 - protein, 244 aa, Homo sapiens
  Payload ID: 5622
  Gene Symbol: EIF4G2
  Gene Name: eukaryotic translation initiation factor 4 gamma, 2
  ENSP ID: ENSP00000435523
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILKGVILLIVDKALEEPKYSSLYAQLCLRLAEDAPNFDGPAAEGQPGQKQSTTFRRLLISKLQDEFENRTRNVDVYDKRENPLLPEEEEQRAIAKIKMLGNIKFIGELGKLDLIHESILHKCIKTLLEKKKRVQL

SEQ ID NO: 28821 - protein, 84 aa, Homo sapiens
  Payload ID: 5622
  Gene Symbol: EIF4G2
  Gene Name: eukaryotic translation initiation factor 4 gamma, 2
  ENSP ID: ENSP00000435912
VESAIAEGGASRFSEFLGKTPGQNAQKWIPARSTRRDDNSAANNSANEKERHDAIFRKVRGILNKLTPEKFDKLCLELLNVGVE

SEQ ID NO: 28822 - protein, 112 aa, Homo sapiens
  Payload ID: 5622
  Gene Symbol: EIF4G2
  Gene Name: eukaryotic translation initiation factor 4 gamma, 2
  ENSP ID: ENSP00000436235
VESAIAEGGASRFSASSGGGGSRGAPQHYPKTAGNSEFLGKTPGQNAQKWIPARSTRRDDNSAANNSANEKERHDAIFRKVRGILNKLTPEKFDKLCLELLNVGVESKLILK

SEQ ID NO: 28823 - protein, 20 aa, Homo sapiens
  Payload ID: 5622
  Gene Symbol: EIF4G2
  Gene Name: eukaryotic translation initiation factor 4 gamma, 2
  ENSP ID: ENSP00000436680
  MOD_RES (1)..(1): Any amino acid
XEKERHDAIFRKVRGLWTKP

SEQ ID NO: 28824 - protein, 1585 aa, Homo sapiens
  Payload ID: 5623
  Gene Symbol: EIF4G3
  Gene Name: eukaryotic translation initiation factor 4 gamma, 3
  Uniprot ID: O43432
  ENSP ID: ENSP00000264211
MNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 28825 - protein, 515 aa, Homo sapiens
  Payload ID: 5623
  Gene Symbol: EIF4G3
  Gene Name: eukaryotic translation initiation factor 4 gamma, 3
  Uniprot ID: O43432
  ENSP ID: ENSP00000349386
MNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPETSNEC

SEQ ID NO: 28826 - protein, 1305 aa, Homo sapiens
  Payload ID: 5623
  Gene Symbol: EIF4G3
  Gene Name: eukaryotic translation initiation factor 4 gamma, 3
  Uniprot ID: O43432
  ENSP ID: ENSP00000364071
MNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 28827 - protein, 1621 aa, Homo sapiens
  Payload ID: 5623
  Gene Symbol: EIF4G3
  Gene Name: eukaryotic translation initiation factor 4 gamma, 3
  ENSP ID: ENSP00000383274
MNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 28828 - protein, 217 aa, Homo sapiens
  Payload ID: 5623
  Gene Symbol: EIF4G3
  Gene Name: eukaryotic translation initiation factor 4 gamma, 3
  ENSP ID: ENSP00000395381
MNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQK

SEQ ID NO: 28829 - protein, 220 aa, Homo sapiens
  Payload ID: 5623
  Gene Symbol: EIF4G3
  Gene Name: eukaryotic translation initiation factor 4 gamma, 3
  ENSP ID: ENSP00000396083
MNSQPQTRSPPSRTVPIHCTDNWKRRKVLEQTPVYRSLAGRGWIKYCIFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQ

SEQ ID NO: 28830 - protein, 1591 aa, Homo sapiens
  Payload ID: 5623
  Gene Symbol: EIF4G3
  Gene Name: eukaryotic translation initiation factor 4 gamma, 3
  Uniprot ID: O43432
  ENSP ID: ENSP00000473510
MNSQPQTRSPGGFRPIQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 28831 - protein, 1774 aa, Homo sapiens
  Payload ID: 5623
  Gene Symbol: EIF4G3
  Gene Name: eukaryotic translation initiation factor 4 gamma, 3
  ENSP ID: ENSP00000489051
VKKIHRHRLSPATEKGAASSGEGDKDPPPPAHEDIAVKGTATAAGTGPGTGAAAAAAAAVPPPHPAAAAAAAAAAAAAAAAAVPPPHPNIRALQTQAPQQIPRGPVQQPLEDRIFTPAVSAVYSTVTQVARQPGTPTPSPYSAHEINKGHPNLAATPPGHASSPGLSQTPYPSGQNAGPTTLVYPQTPQTMNSQPQTRSPFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQLPSQVPEHSPVVYGTVESAHLAASTPVTAASDQKQEEKPKPDPVLKSPSPVLRLVLSGEKKEQEGQTSETTAIVSIAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQKLDFIESDSPCSSEALSKKELSAEELYKRLEKLIIEDKANDEQIFDWVEANLDEIQMSSPTFLRALMTAVCKAAIIADSSTFRVDTAVIKQRVPILLKYLDSDTEKELQALYALQASIVKLDQPANLLRMFFDCLYDEEVISEDAFYKWESSKDPAEQNGKGVALKSVTAFFTWLREAEEESEDN

SEQ ID NO: 28832 - protein, 406 aa, Homo sapiens
  Payload ID: 5624
  Gene Symbol: EIF4A1
  Gene Name: eukaryotic translation initiation factor 4A1
  Uniprot ID: P60842
  ENSP ID: ENSP00000293831
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLARGIDVQQVSLVINYDLPTNRENYIHRIGRGGRFGRKGVAINMVTEEDKRTLRDIETFYNTSIEEMPLNVADLI

SEQ ID NO: 28833 - protein, 85 aa, Homo sapiens
  Payload ID: 5624
  Gene Symbol: EIF4A1
  Gene Name: eukaryotic translation initiation factor 4A1
  ENSP ID: ENSP00000461921
MSASQDSRTEPNPEERPREAPGAHPAPGGRVHFAAQAGLLANCGWAGPPSFGGERPEIQRQWPRWDGARRRHRVTGMRLLTALMT

SEQ ID NO: 28834 - protein, 187 aa, Homo sapiens
  Payload ID: 5624
  Gene Symbol: EIF4A1
  Gene Name: eukaryotic translation initiation factor 4A1
  ENSP ID: ENSP00000462275
MSASQDSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLS

SEQ ID NO: 28835 - protein, 85 aa, Homo sapiens
  Payload ID: 5624
  Gene Symbol: EIF4A1
  Gene Name: eukaryotic translation initiation factor 4A1
  ENSP ID: ENSP00000462372
MEPEGVIESNWNEIVDSFDDMNLSESLLRGIYAYGFEKPSAIQQRAILPCIKGYDVIAQAQSGTGKTATFAISILQQIELDLKAT

SEQ ID NO: 28836 - protein, 50 aa, Homo sapiens
  Payload ID: 5624
  Gene Symbol: EIF4A1
  Gene Name: eukaryotic translation initiation factor 4A1
  ENSP ID: ENSP00000462581
MRWPGRSRALYKLSIGGHSALVSKDHVCEPGFPIQRQWPRWDGARRRHRE

SEQ ID NO: 28837 - protein, 230 aa, Homo sapiens
  Payload ID: 5624
  Gene Symbol: EIF4A1
  Gene Name: eukaryotic translation initiation factor 4A1
  ENSP ID: ENSP00000462719
  MOD_RES (1)..(1): Any amino acid
XVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLGKLYPQNRSRWTVWP

SEQ ID NO: 28838 - protein, 85 aa, Homo sapiens
  Payload ID: 5624
  Gene Symbol: EIF4A1
  Gene Name: eukaryotic translation initiation factor 4A1
  ENSP ID: ENSP00000462741
MGRSTFLRGSRDNGPDGMEPEGVIESNWNEIVDSFDDMNLSESLLRGIYAYGFEKPSAIQQRAILPCIKGYDVIAQAQSGTGKTA

SEQ ID NO: 28839 - protein, 341 aa, Homo sapiens
  Payload ID: 5624
  Gene Symbol: EIF4A1
  Gene Name: eukaryotic translation initiation factor 4A1
  ENSP ID: ENSP00000462753
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLNRSRWTVWP

SEQ ID NO: 28840 - protein, 257 aa, Homo sapiens
  Payload ID: 5624
  Gene Symbol: EIF4A1
  Gene Name: eukaryotic translation initiation factor 4A1
  ENSP ID: ENSP00000462904
MEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTIT

SEQ ID NO: 28841 - protein, 117 aa, Homo sapiens
  Payload ID: 5624
  Gene Symbol: EIF4A1
  Gene Name: eukaryotic translation initiation factor 4A1
  ENSP ID: ENSP00000463067
MFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHA

SEQ ID NO: 28842 - protein, 134 aa, Homo sapiens
  Payload ID: 5624
  Gene Symbol: EIF4A1
  Gene Name: eukaryotic translation initiation factor 4A1
  ENSP ID: ENSP00000463309
MNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRY

SEQ ID NO: 28843 - protein, 271 aa, Homo sapiens
  Payload ID: 5624
  Gene Symbol: EIF4A1
  Gene Name: eukaryotic translation initiation factor 4A1
  ENSP ID: ENSP00000463366
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQEELTLEGIRQFYINVEREEWKLDTLCDLYETLTITQAVIFINTRRKVDWLTEKMHARDFTVSA

SEQ ID NO: 28844 - protein, 68 aa, Homo sapiens
  Payload ID: 5624
  Gene Symbol: EIF4A1
  Gene Name: eukaryotic translation initiation factor 4A1
  ENSP ID: ENSP00000463380
INTRRKVDWLTEKMHARDFTVSAMHGDMDQKERDVIMREFRSGSSRVLITTDLLSVLRAHAEELSFLT

SEQ ID NO: 28845 - protein, 347 aa, Homo sapiens
  Payload ID: 5624
  Gene Symbol: EIF4A1
  Gene Name: eukaryotic translation initiation factor 4A1
  Uniprot ID: P60842
  ENSP ID: ENSP00000463486
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLGKLYPQNRSRWTVWP

SEQ ID NO: 28846 - protein, 163 aa, Homo sapiens
  Payload ID: 5624
  Gene Symbol: EIF4A1
  Gene Name: eukaryotic translation initiation factor 4A1
  ENSP ID: ENSP00000463634
MNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDI

SEQ ID NO: 28847 - protein, 95 aa, Homo sapiens
  Payload ID: 5624
  Gene Symbol: EIF4A1
  Gene Name: eukaryotic translation initiation factor 4A1
  ENSP ID: ENSP00000463821
MSASQDSRSRDNGPDGMEPEGVIESNWNEIVDSFDDMNLSESLLRGIYAYGFEKPSAIQQRAILPCIKDTEGGHGTRRLHGRLLSRLYRGHQRAC

SEQ ID NO: 28848 - protein, 214 aa, Homo sapiens
  Payload ID: 5624
  Gene Symbol: EIF4A1
  Gene Name: eukaryotic translation initiation factor 4A1
  ENSP ID: ENSP00000464066
  MOD_RES (1)..(1): Any amino acid
XAWAHCARGRHRPRPPTSGSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKL

SEQ ID NO: 28849 - protein, 74 aa, Homo sapiens
  Payload ID: 5624
  Gene Symbol: EIF4A1
  Gene Name: eukaryotic translation initiation factor 4A1
  ENSP ID: ENSP00000464082
MSASQDSRTEPNPEERPREAPGAHPAPGGRVHFAAQAGLLANCGWAGPPSFGGERPEIQRQWPRWDGARRRHRE

SEQ ID NO: 28850 - protein, 74 aa, Homo sapiens; identical to SEQ ID NO: 28849
  Payload ID: 5624
  Gene Symbol: EIF4A1
  Gene Name: eukaryotic translation initiation factor 4A1
  ENSP ID: ENSP00000464320

SEQ ID NO: 28851 - protein, 300 aa, Homo sapiens
  Payload ID: 5624
  Gene Symbol: EIF4A1
  Gene Name: eukaryotic translation initiation factor 4A1
  ENSP ID: ENSP00000464550
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAM

SEQ ID NO: 28852 - protein, 407 aa, Homo sapiens
  Payload ID: 5625
  Gene Symbol: EIF4A2
  Gene Name: eukaryotic translation initiation factor 4A2
  Uniprot ID: Q14240
  ENSP ID: ENSP00000326381
MSGGSADYNREHGGPEGMDPDGVIESNWNEIVDNFDDMNLKESLLRGIYAYGFEKPSAIQQRAIIPCIKGYDVIAQAQSGTGKTATFAISILQQLEIEFKETQALVLAPTRELAQQIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVLLSATMPTDVLEVTKKFMRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRIGRGGRFGRKGVAINFVTEEDKRILRDIETFYNTTVEEMPMNVADLI

SEQ ID NO: 28853 - protein, 96 aa, Homo sapiens
  Payload ID: 5625
  Gene Symbol: EIF4A2
  Gene Name: eukaryotic translation initiation factor 4A2
  ENSP ID: ENSP00000388237
MSGGSADYNREHGGPEGMDPDGVIESNWNEIVDNFDDMNLKESLLRGIYAYGFEKPSAIQQRAIIPCIKDPKGNSGTWRLYGSHLSCLHWWNKCSK

SEQ ID NO: 28854 - protein, 96 aa, Homo sapiens; identical to SEQ ID NO: 28853
  Payload ID: 5625
  Gene Symbol: EIF4A2
  Gene Name: eukaryotic translation initiation factor 4A2
  ENSP ID: ENSP00000392686

SEQ ID NO: 28855 - protein, 408 aa, Homo sapiens
  Payload ID: 5625
  Gene Symbol: EIF4A2
  Gene Name: eukaryotic translation initiation factor 4A2
  Uniprot ID: Q14240
  ENSP ID: ENSP00000398370
MSGGSADYNSREHGGPEGMDPDGVIESNWNEIVDNFDDMNLKESLLRGIYAYGFEKPSAIQQRAIIPCIKGYDVIAQAQSGTGKTATFAISILQQLEIEFKETQALVLAPTRELAQQIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVLLSATMPTDVLEVTKKFMRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRIGRGGRFGRKGVAINFVTEEDKRILRDIETFYNTTVEEMPMNVADLI

SEQ ID NO: 28856 - protein, 97 aa, Homo sapiens
  Payload ID: 5625
  Gene Symbol: EIF4A2
  Gene Name: eukaryotic translation initiation factor 4A2
  ENSP ID: ENSP00000402313
MSGGSADYNSREHGGPEGMDPDGVIESNWNEIVDNFDDMNLKESLLRGIYAYGFEKPSAIQQRAIIPCIKDPKGNSGTWRLYGSHLSCLHWWNKCSK

SEQ ID NO: 28857 - protein, 57 aa, Homo sapiens
  Payload ID: 5625
  Gene Symbol: EIF4A2
  Gene Name: eukaryotic translation initiation factor 4A2
  ENSP ID: ENSP00000407504
MSGGSADYNREHGGPEGMDPDGVIESNWNEIVDNFDDMNLKESLLRGIYAYGFEKPS

SEQ ID NO: 28858 - protein, 362 aa, Homo sapiens
  Payload ID: 5625
  Gene Symbol: EIF4A2
  Gene Name: eukaryotic translation initiation factor 4A2
  ENSP ID: ENSP00000413529
MSGGSADYNREHGGPEGMDPDGVIESNWNEIVDNFDDMNLKESLLRGIYAYGFEKPSAIQQRAIIPCIKGYDVIAQAQSGTGKTATFAISILQQLEIEFKETQALVLAPTRELAQQIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVLLSATMPTDVLEVTKKFMRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRSR

SEQ ID NO: 28859 - protein, 98 aa, Homo sapiens
  Payload ID: 5625
  Gene Symbol: EIF4A2
  Gene Name: eukaryotic translation initiation factor 4A2
  ENSP ID: ENSP00000415878
MSGGSADYNREHGGPEGMDPDGVIESNWNEIVDNFDDMNLKESLLRGIYAYGFEKPSAIQQRAIIPCIKGYDVIAQAQSGTGKTATFAISILQQLEIE

SEQ ID NO: 28860 - protein, 109 aa, Homo sapiens
  Payload ID: 5625
  Gene Symbol: EIF4A2
  Gene Name: eukaryotic translation initiation factor 4A2
  ENSP ID: ENSP00000462571
MDPDGVIESNWNEIVDNFDDMNLKESLLRGIYAYGFEKPSAIQQRAIIPCIKGYDVIAQAQSGTGKTATFAISILQQLEIEFKETQALVLAPTRELAQQIQKVILALGD

SEQ ID NO: 28861 - protein, 411 aa, Homo sapiens
  Payload ID: 5626
  Gene Symbol: EIF4A3
  Gene Name: eukaryotic translation initiation factor 4A3
  Uniprot ID: P38919
  ENSP ID: ENSP00000269349
MATTATMATSGSARKRLLKEEDMTKVEFETSEEVDVTPTFDTMGLREDLLRGIYAYGFEKPSAIQQRAIKQIIKGRDVIAQSQSGTGKTATFSISVLQCLDIQVRETQALILAPTRELAVQIQKGLLALGDYMNVQCHACIGGTNVGEDIRKLDYGQHVVAGTPGRVFDMIRRRSLRTRAIKMLVLDEADEMLNKGFKEQIYDVYRYLPPATQVVLISATLPHEILEMTNKFMTDPIRILVKRDELTLEGIKQFFVAVEREEWKFDTLCDLYDTLTITQAVIFCNTKRKVDWLTEKMREANFTVSSMHGDMPQKERESIMKEFRSGASRVLISTDVWARGLDVPQVSLIINYDLPNNRELYIHRIGRSGRYGRKGVAINFVKNDDIRILRDIEQYYSTQIDEMPMNVADLI

SEQ ID NO: 28862 - protein, 125 aa, Homo sapiens
  Payload ID: 5626
  Gene Symbol: EIF4A3
  Gene Name: eukaryotic translation initiation factor 4A3
  ENSP ID: ENSP00000460439
MATTATMATSGSARKRLLKEEDMTKVEFETSEEVDVTPTFDTMGLREDLLRGIYAYGFEKPSAIQQRAIKQIIKGRDVIAQSQSGTGKTATFSISVLQCLDIQGLLALGDYMNVQCHACIGGTNV

SEQ ID NO: 28863 - protein, 611 aa, Homo sapiens
  Payload ID: 5627
  Gene Symbol: EIF4B
  Gene Name: eukaryotic translation initiation factor 4B
  Uniprot ID: P23588
  ENSP ID: ENSP00000262056
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGLNISAVRLPREPSNPERLKGFGYAEFEDLDSLLSALSLNEESLGNRRIRVDVADQAQDKDRDDRSFGRDRNRDSDKTDTDWRARPATDSFDDYPPRRGDDSFGDKYRDRYDSDRYRDGYRDGYRDGPRRDMDRYGGRDRYDDRGSRDYDRGYDSRIGSGRRAFGSGYRRDDDYRGGGDRYEDRYDRRDDRSWSSRDDYSRDDYRRDDRGPPQRPKLNLKPRSTPKEDDSSASTSQSTRAASIFGGAKPVDTAAREREVEERLQKEQEKLQRQLDEPKLERRPRERHPSWRSEETQERERSRTGSESSQTGTSTTSSRNARRRESEKSLENETLNKEEDCHSPTSKPPKPDQPLKVMPAPPPKENAWVKRSSNPPARSQSSDTEQQSPTSGGGKVAPAQPSEEGPGRKDENKVDGMNAPKGQTGNSSRGPGDGGNRDHWKESDRKDGKKDQDSRSAPEPKKPEENPASKFSSASKYAALSVDGEDENEGEDYAE

SEQ ID NO: 28864 - protein, 616 aa, Homo sapiens
  Payload ID: 5627
  Gene Symbol: EIF4B
  Gene Name: eukaryotic translation initiation factor 4B
  ENSP ID: ENSP00000388806
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGLNISAVRLPREPSNPERLKGFGYAEFEDLDSLLSALSLNEESLGNRRIRVDVADQAQDKDRDDRSFGRDRNRDSDKTDTDWRARPATDSFDDYPPRRGDDSFGDKYRDRYDSDRYRDGYRDGYRDGPRRDMDRYGGRDRYDDRGSRDYDRGYDSRIGSGRRAFGSGYRRDDDYRGGGDRYEDRYDRRDDRSWSSRDDYSRDDYRRDDRGPPQRPKLNLKPRSTPKEDDSSASTSQSTRAASIFGGAKPVDTAAREREVEERLQKEQEKLQRQLDEPKLERRPRERHPSWRSEETQERERSRTGSESSQTGTSTTSSRSKSDQDARRRESEKSLENETLNKEEDCHSPTSKPPKPDQPLKVMPAPPPKENAWVKRSSNPPARSQSSDTEQQSPTSGGGKVAPAQPSEEGPGRKDENKVDGMNAPKGQTGNSSRGPGDGGNRDHWKESDRKDGKKDQDSRSAPEPKKPEENPASKFSSASKYAALSVDGEDENEGEDYAE

SEQ ID NO: 28865 - protein, 572 aa, Homo sapiens
  Payload ID: 5627
  Gene Symbol: EIF4B
  Gene Name: eukaryotic translation initiation factor 4B
  Uniprot ID: P23588
  ENSP ID: ENSP00000412530
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGLNSLGNRRIRVDVADQAQDKDRDDRSFGRDRNRDSDKTDTDWRARPATDSFDDYPPRRGDDSFGDKYRDRYDSDRYRDGYRDGYRDGPRRDMDRYGGRDRYDDRGSRDYDRGYDSRIGSGRRAFGSGYRRDDDYRGGGDRYEDRYDRRDDRSWSSRDDYSRDDYRRDDRGPPQRPKLNLKPRSTPKEDDSSASTSQSTRAASIFGGAKPVDTAAREREVEERLQKEQEKLQRQLDEPKLERRPRERHPSWRSEETQERERSRTGSESSQTGTSTTSSRNARRRESEKSLENETLNKEEDCHSPTSKPPKPDQPLKVMPAPPPKENAWVKRSSNPPARSQSSDTEQQSPTSGGGKVAPAQPSEEGPGRKDENKVDGMNAPKGQTGNSSRGPGDGGNRDHWKESDRKDGKKDQDSRSAPEPKKPEENPASKFSSASKYAALSVDGEDENEGEDYAE

SEQ ID NO: 28866 - protein, 169 aa, Homo sapiens
  Payload ID: 5627
  Gene Symbol: EIF4B
  Gene Name: eukaryotic translation initiation factor 4B
  ENSP ID: ENSP00000447192
MAASVSTTWHSNDDDVYRAPPIDRSILPTAPRAAREPNIDRSRLPKSPPYTAFLGNLPYDVTEESIKEFFRGLNISAVRLPREPSNPERLKGFGYAEFEDLDSLLSALSLNEESLGNRRIRVDVADQAQDKDRDDRSFGRDRNRDSDKTDTDWRARPATDSFDDYPPRR

SEQ ID NO: 28867 - protein, 227 aa, Homo sapiens
  Payload ID: 5627
  Gene Symbol: EIF4B
  Gene Name: eukaryotic translation initiation factor 4B
  ENSP ID: ENSP00000448365
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGLNISAVRLPREPSNPERLKGFGYAEFEDLDSLLSALSLNEESLGNRRIRVDVADQAQDKDRDDRSFGRDRNRDSDKTDTDWRARPATDSFDDYPPRRGDDSFGDRRNGS

SEQ ID NO: 28868 - protein, 175 aa, Homo sapiens
  Payload ID: 5627
  Gene Symbol: EIF4B
  Gene Name: eukaryotic translation initiation factor 4B
  ENSP ID: ENSP00000448399
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGLNISAVRLPREPSNPERLKGFGYAEFEDLDSLLSALSLNEECFCYAQTFKVTQGICA

SEQ ID NO: 28869 - protein, 185 aa, Homo sapiens
  Payload ID: 5627
  Gene Symbol: EIF4B
  Gene Name: eukaryotic translation initiation factor 4B
  ENSP ID: ENSP00000448980
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGLNISAVRLPREPSNPERLKGFGYAEFEDLDSLLSALSLNEESLGNRRIRVDVADQAQDKGTPGPYRI

SEQ ID NO: 28870 - protein, 360 aa, Homo sapiens
  Payload ID: 5627
  Gene Symbol: EIF4B
  Gene Name: eukaryotic translation initiation factor 4B
  ENSP ID: ENSP00000449746
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGLNISAVRLPREPSNPERLKGFGYAEFEDLDSLLSALSLNEESLGNRRIRVDVADQAQDKEYRDRYDSDRYRDGYRDGYRDGPRRDMDRYGGRDRYDDRGSRDYDRGYDSRIGSGRRAFGSGYRRDDDYRGGGDRYEDRYDRRDDRSWSSRDDYSRDDYRRDDRGPPQRPKLNLKPRSTPKEDDSSASTSQSTRAASIFGGAKPVDTAAREREVEERLQKEQEKLQRQLDEPKLERRPRERHP

SEQ ID NO: 28871 - protein, 275 aa, Homo sapiens
  Payload ID: 5627
  Gene Symbol: EIF4B
  Gene Name: eukaryotic translation initiation factor 4B
  ENSP ID: ENSP00000450324
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEFFRGLNISAVRLPREPSNPERLKGFGYAEFEDLDSLLSALSLNEESLGNRRIRVDVADQAQDKDRDDRSFGRDRNRDSDKTDTDWRARPATDSFDDYPPRRGDDSFGDSYDSRIGSGRRAFGSGYRRDDDYRGGGDRYEDRYDRRDDRSWSSRDDYSRDDY

SEQ ID NO: 28872 - protein, 237 aa, Homo sapiens
  Payload ID: 5628
  Gene Symbol: EIF4E
  Gene Name: eukaryotic translation initiation factor 4E
  Uniprot ID: P06730
  ENSP ID: ENSP00000280892
MLDLTSRGQVGTSRRMAEAACSAHFLETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECENREAVTHIGRVYKERLGLPPKIVIGYQSHADTATKSGSTTKNRFVV

SEQ ID NO: 28873 - protein, 217 aa, Homo sapiens [sequence omitted]

SEQ ID NO: 28874 - protein, 155 aa, Homo sapiens
  Payload ID: 5628
  Gene Symbol: EIF4E
  Gene Name: eukaryotic translation initiation factor 4E
  ENSP ID: ENSP00000421287
  MOD_RES (1)..(1): Any amino acid
XEPETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETEGIQGKVRTSSKDSDWLSVPRRHSY

SEQ ID NO: 28875 - protein, 245 aa, Homo sapiens
  Payload ID: 5628
  Gene Symbol: EIF4E
  Gene Name: eukaryotic translation initiation factor 4E
  ENSP ID: ENSP00000423977
MKKKQNKKERKKMRAEDGENDAIKKQAESLRESQETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECENREAVTHIGRVYKERLGLPPKIVIGYQSHADTATKSGSTTKNRFVV

SEQ ID NO: 28876 - protein, 248 aa, Homo sapiens
  Payload ID: 5628
  Gene Symbol: EIF4E
  Gene Name: eukaryotic translation initiation factor 4E
  Uniprot ID: P06730
  ENSP ID: ENSP00000425561
MATVEPETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETRWDLAMLPRLVSNFWPQVILPLQPPKVLELQLLCLIGESFDDYSDDVCGAVVNVRAKGDKIAIWTTECENREAVTHIGRVYKERLGLPPKIVIGYQSHADTATKSGSTTKNRFVV

SEQ ID NO: 28877 - protein, 42 aa, Homo sapiens
  Payload ID: 5628
  Gene Symbol: EIF4E
  Gene Name: eukaryotic translation initiation factor 4E
  ENSP ID: ENSP00000426602
MATVEPETTPTPNPPTTEEEKTESNQEVANPEHYIKHPLQNR

SEQ ID NO: 28878 - protein, 118 aa, Homo sapiens
  Payload ID: 5629
  Gene Symbol: EIF4EBP1
  Gene Name: eukaryotic translation initiation factor 4E binding protein 1
  Uniprot ID: Q13541
  ENSP ID: ENSP00000340691
MSGGSSCSQTPSRAIPATRRVVLGDGVQLPPGDYSTTPGGTLFSTTPGGTRIIYDRKFLMECRNSPVTKTPPRDLPTIPGVTSPSSDEPPMEASQSHLRNSPEDKRAGGEESQFEMDI

SEQ ID NO: 28879 - protein, 120 aa, Homo sapiens
  Payload ID: 5630
  Gene Symbol: EIF4EBP2
  Gene Name: eukaryotic translation initiation factor 4E binding protein 2
  Uniprot ID: Q13542
  ENSP ID: ENSP00000362314
MSSSAGSGHQPSQSRAIPTRTVAISDAAQLPHDYCTTPGGTLFSTTPGGTRIIYDRKFLLDRRNSPMAQTPPCHLPNIPGVTSPGTLIEDSKVEVNNLNNLNNHDRKHAVGDDAQFEMDI

SEQ ID NO: 28880 - protein, 100 aa, Homo sapiens
  Payload ID: 5631
  Gene Symbol: EIF4EBP3
  Gene Name: eukaryotic translation initiation factor 4E binding protein 3
  Uniprot ID: O60516
  ENSP ID: ENSP00000308472
MSTSTSCPIPGGRDQLPDCYSTTPGGTLYATTPGGTRIIYDRKFLLECKNSPIARTPPCCLPQIPGVTTPPTAPLSKLEELKEQETEEEIPDDAQFEMDI

SEQ ID NO: 28881 - protein, 242 aa, Homo sapiens
  Payload ID: 5632
  Gene Symbol: EIF4E1B
  Gene Name: eukaryotic translation initiation factor 4E family member 1B
  Uniprot ID: A6NMX2
  ENSP ID: ENSP00000323714
MLAVEVSEAEGGIREWEEEEKEEEAAERTPTGEKSPNSPRTLLSLRGKARTGGPMEVKLELHPLQNRWALWFFKNDRSRAWQDNLHLVTKVDTVEDFWALYSHIQLASKLSSGCDYALFKDGIQPMWEDSRNKRGGRWLVSLAKQQRHIELDRLWLETLLCLIGESFEEHSREVCGAVVNIRTKGDKIAVWTREAENQAGVLHVGRVYKERLGLSPKTIIGYQAHADTATKSNSLAKNKFVV

SEQ ID NO: 28882 - protein, 90 aa, Homo sapiens
  Payload ID: 5632
  Gene Symbol: EIF4E1B
  Gene Name: eukaryotic translation initiation factor 4E family member 1B
  ENSP ID: ENSP00000421009
MLAVEVSEAEGGIREWEEEEKEEEAAERTPTGEKSPNSPRTLLSLRGKARTGGPMEVKLELHPLQNRWALWFFKNDRSRAWQDNLHLVTK

SEQ ID NO: 28883 - protein, 171 aa, Homo sapiens
  Payload ID: 5632
  Gene Symbol: EIF4E1B
  Gene Name: eukaryotic translation initiation factor 4E family member 1B
  ENSP ID: ENSP00000422420
  MOD_RES (1)..(1): Any amino acid
XLHPLQNRWALWFFKNDRSRAWQDNLHLVTKVDTVEDFWALYSHIQLASKLSSGCDYALFKDGIQPMWEDSRNKRGGRWLVSLAKQQRHIELDRLWLETQRGMWGRRQHPHQGGQDRCVDEGGGKPGGRAARWACIQRAPGPLPKDHHWVPGPCRHSHQEQLPSQEQVCGV

SEQ ID NO: 28884 - protein, 242 aa, Homo sapiens; identical to SEQ ID NO: 28881
  Payload ID: 5632
  Gene Symbol: EIF4E1B
  Gene Name: eukaryotic translation initiation factor 4E family member 1B
  Uniprot ID: A6NMX2
  ENSP ID: ENSP00000427633

SEQ ID NO: 28885 - protein, 245 aa, Homo sapiens
  Payload ID: 5633
  Gene Symbol: EIF4E2
  Gene Name: eukaryotic translation initiation factor 4E family member 2
  Uniprot ID: O60573
  ENSP ID: ENSP00000258416
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKMPGRLGPQRLLFQNLWKPRLNVP

SEQ ID NO: 28886 - protein, 200 aa, Homo sapiens
  Payload ID: 5633
  Gene Symbol: EIF4E2
  Gene Name: eukaryotic translation initiation factor 4E family member 2
  ENSP ID: ENSP00000386424
MNNKFDALKDDDSGDHDQNEENSTQKDGEKEKTERDKNQSSSKRKVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKMPGRLGPQRLLFQNLWKPRLNVP

SEQ ID NO: 28887 - protein, 233 aa, Homo sapiens
  Payload ID: 5633
  Gene Symbol: EIF4E2
  Gene Name: eukaryotic translation initiation factor 4E family member 2
  ENSP ID: ENSP00000386876
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKYVLGGYGRTCP

SEQ ID NO: 28888 - protein, 189 aa, Homo sapiens
  Payload ID: 5633
  Gene Symbol: EIF4E2
  Gene Name: eukaryotic translation initiation factor 4E family member 2
  ENSP ID: ENSP00000386983
MNNKFDALKDDDSGDHDQNEENSTQKDGEKEKTERDKNQSSSKRKVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKDNSSFRNTKITL

SEQ ID NO: 28889 - protein, 234 aa, Homo sapiens
  Payload ID: 5633
  Gene Symbol: EIF4E2
  Gene Name: eukaryotic translation initiation factor 4E family member 2
  Uniprot ID: O60573
  ENSP ID: ENSP00000386996
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKDNSSFRNTKITL

SEQ ID NO: 28890 - protein, 188 aa, Homo sapiens
  Payload ID: 5633
  Gene Symbol: EIF4E2
  Gene Name: eukaryotic translation initiation factor 4E family member 2
  ENSP ID: ENSP00000387328
MNNKFDALKDDDSGDHDQNEENSTQKDGEKEKTERDKNQSSSKRKVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKYVLGGYGRTCP

SEQ ID NO: 28891 - protein, 236 aa, Homo sapiens
  Payload ID: 5633
  Gene Symbol: EIF4E2
  Gene Name: eukaryotic translation initiation factor 4E family member 2
  ENSP ID: ENSP00000387336
MNNKFDALKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHTDSIKAWEEFHGLVNSSGR

SEQ ID NO: 28892 - protein, 121 aa, Homo sapiens
  Payload ID: 5633
  Gene Symbol: EIF4E2
  Gene Name: eukaryotic translation initiation factor 4E family member 2
  ENSP ID: ENSP00000389578
RVGCSAPRKGKSSGTSLLCSQGLGGVSWPGEQQRPLIGRSPSVSHTQGTIQAFEIQKSHCESTQAGNNPFLYVCVCPKWMGGLQPVLPLLTEGTSLSRALSFCTHSWRTDSARHPPASLTL

SEQ ID NO: 28893 - protein, 213 aa, Homo sapiens
  Payload ID: 5633
  Gene Symbol: EIF4E2
  Gene Name: eukaryotic translation initiation factor 4E family member 2
  ENSP ID: ENSP00000390904
MSLKDDDSGDHDQNEENSTQKDGEKEKTERDKNQSSSKRKAVVPGPAEHPLQYNYTFWYSRRTPGRPTSSQSYEQNIKQIGTFASVEQFWRFYSHMVRPGDLTGHSDFHLFKEGIKPMWEDDANKNGGKWIIRLRKGLASRCWENLILAMLGEQFMVGEEICGAVVSVRFQEDIISIWNKTASDQATTARIRDTLRRVLNLPPNTIMEYKTHT

SEQ ID NO: 28894 - protein, 118 aa, Homo sapiens
  Payload ID: 5634
  Gene Symbol: EIF4E3
  Gene Name: eukaryotic translation initiation factor 4E family member 3
  Uniprot ID: Q8N5X7
  ENSP ID: ENSP00000295612
MRGERRPLWEEESNAKGGVWKMKVPKDSTSTVWKELLLATIGEQFTDCAAADDEVIGVSVSVRDREDVVQVWNVNASLVGEATVLEKIYELLPHITFKAVFYKPHEEHHAFEGGRGKH

SEQ ID NO: 28895 - protein, 118 aa, Homo sapiens; identical to SEQ ID NO: 28894
  Payload ID: 5634
  Gene Symbol: EIF4E3
  Gene Name: eukaryotic translation initiation factor 4E family member 3
  Uniprot ID: Q8N5X7
  ENSP ID: ENSP00000374476

SEQ ID NO: 28896 - protein, 224 aa, Homo sapiens
  Payload ID: 5634
  Gene Symbol: EIF4E3
  Gene Name: eukaryotic translation initiation factor 4E family member 3
  Uniprot ID: Q8N5X7
  ENSP ID: ENSP00000393324
MALPPAAAPPAGAREPPGSRAAAAAAAPEPPLGLQQLSALQPEPGGVPLHSSWTFWLDRSLPGATAAECASNLKKIYTVQTVQIFWSVYNNIPPVTSLPLRCSYHLMRGERRPLWEEESNAKGGVWKMKVPKDSTSTVWKELLLATIGEQFTDCAAADDEVIGVSVSVRDREDVVQVWNVNASLVGEATVLEKIYELLPHITFKAVFYKPHEEHHAFEGGRGKH

SEQ ID NO: 28897 - protein, 118 aa, Homo sapiens; identical to SEQ ID NO: 28894
  Payload ID: 5634
  Gene Symbol: EIF4E3
  Gene Name: eukaryotic translation initiation factor 4E family member 3
  Uniprot ID: Q8N5X7
  ENSP ID: ENSP00000410350

SEQ ID NO: 28898 - protein, 118 aa, Homo sapiens; identical to SEQ ID NO: 28894
  Payload ID: 5634
  Gene Symbol: EIF4E3
  Gene Name: eukaryotic translation initiation factor 4E family member 3
  Uniprot ID: Q8N5X7
  ENSP ID: ENSP00000411762

SEQ ID NO: 28899 - protein, 51 aa, Homo sapiens
  Payload ID: 5634
  Gene Symbol: EIF4E3
  Gene Name: eukaryotic translation initiation factor 4E family member 3
  ENSP ID: ENSP00000417889
MRGERRPLWEEESNAKGGVWKMKVPKDSTSTVWKELLLATIGEQFTDCAAA

SEQ ID NO: 28900 - protein, 93 aa, Homo sapiens
  Payload ID: 5634
  Gene Symbol: EIF4E3
  Gene Name: eukaryotic translation initiation factor 4E family member 3
  ENSP ID: ENSP00000418211
MRGERRPLWEEESNAKGGVWKMKVPKDSTSTVWKELLLATIGEQFTDCAAADDEVIGVSVSVRDREDVVQVWNVNASLVGEATVLEKIYELLP

SEQ ID NO: 28901 - protein, 44 aa, Homo sapiens
  Payload ID: 5634
  Gene Symbol: EIF4E3
  Gene Name: eukaryotic translation initiation factor 4E family member 3
  ENSP ID: ENSP00000419421
MRGERRPLWEEESNAKGGVWKMKVPKDSTSTVWKELLLATIGEQ

SEQ ID NO: 28902 - protein, 985 aa, Homo sapiens
  Payload ID: 5635
  Gene Symbol: EIF4ENIF1
  Gene Name: eukaryotic translation initiation factor 4E nuclear import factor 1
  Uniprot ID: Q9NRA8
  ENSP ID: ENSP00000328103
MDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 28903 - protein, 811 aa, Homo sapiens
  Payload ID: 5635
  Gene Symbol: EIF4ENIF1
  Gene Name: eukaryotic translation initiation factor 4E nuclear import factor 1
  Uniprot ID: Q9NRA8
  ENSP ID: ENSP00000342927
MDRRSMGETESGDAFLDLKKPPASKCPHRYTKEELLDIKELPHSKQRPSCLSEKYDSDGVWDPEKWHASLYPASGRSSPVESLKKELDTDRPSLVRRIVGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 28904 - protein, 63 aa, Homo sapiens
  Payload ID: 5635
  Gene Symbol: EIF4ENIF1
  Gene Name: eukaryotic translation initiation factor 4E nuclear import factor 1
  ENSP ID: ENSP00000380652
MDRRSMGETESGDAFLDLKKPPASKCPHRYTKEELLDIKELPHSKQRPSCLSEKYDSDGVWDP

SEQ ID NO: 28905 - protein, 63 aa, Homo sapiens; identical to SEQ ID NO: 28904
  Payload ID: 5635
  Gene Symbol: EIF4ENIF1
  Gene Name: eukaryotic translation initiation factor 4E nuclear import factor 1
  ENSP ID: ENSP00000380654

SEQ ID NO: 28906 - protein, 961 aa, Homo sapiens
  Payload ID: 5635
  Gene Symbol: EIF4ENIF1
  Gene Name: eukaryotic translation initiation factor 4E nuclear import factor 1
  ENSP ID: ENSP00000380657
MDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 28907 - protein, 985 aa, Homo sapiens; identical to SEQ ID NO: 28902
  Payload ID: 5635
  Gene Symbol: EIF4ENIF1
  Gene Name: eukaryotic translation initiation factor 4E nuclear import factor 1
  Uniprot ID: Q9NRA8
  ENSP ID: ENSP00000380659

SEQ ID NO: 28908 - protein, 94 aa, Homo sapiens
  Payload ID: 5635
  Gene Symbol: EIF4ENIF1
  Gene Name: eukaryotic translation initiation factor 4E nuclear import factor 1
  ENSP ID: ENSP00000395293
  MOD_RES (1)..(1): Any amino acid
XDYLRPRIPSPIGFTPGPQQLLGDPFQGMRKPMSPITAQMSQLELQQAALEGLALPHDLAVQAANFYQPGFGKPQVDRTRDGFRNRFNVLIKLP

SEQ ID NO: 28909 - protein, 188 aa, Homo sapiens
  Payload ID: 5635
  Gene Symbol: EIF4ENIF1
  Gene Name: eukaryotic translation initiation factor 4E nuclear import factor 1
  ENSP ID: ENSP00000405086
MDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVLSPQRRSFGGGCHVTAAVSSRRSGSPLEKDSDGLRLLGGRRIGSGRIISARTFEKDHRLSDKDLRDLRDRDRERD

SEQ ID NO: 28910 - protein, 239 aa, Homo sapiens
  Payload ID: 5635
  Gene Symbol: EIF4ENIF1
  Gene Name: eukaryotic translation initiation factor 4E nuclear import factor 1
  ENSP ID: ENSP00000413690
QKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSP

SEQ ID NO: 28911 - protein, 248 aa, Homo sapiens
  Payload ID: 5636
  Gene Symbol: EIF4H
  Gene Name: eukaryotic translation initiation factor 4H
  Uniprot ID: Q15056
  ENSP ID: ENSP00000265753
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGMGSSRESRGGWDSRDDFNSGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 28912 - protein, 228 aa, Homo sapiens
  Payload ID: 5636
  Gene Symbol: EIF4H
  Gene Name: eukaryotic translation initiation factor 4H
  Uniprot ID: Q15056
  ENSP ID: ENSP00000265754
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPPMGSRFRDGPPLRGSNMDFREPTEEERAQRPRLQLKPRTVATPLNQVANPNSAIFGGARPREEVVQKEQE

SEQ ID NO: 28913 - protein, 431 aa, Homo sapiens
  Payload ID: 5637
  Gene Symbol: EIF5
  Gene Name: eukaryotic translation initiation factor 5
  Uniprot ID: P55010
  ENSP ID: ENSP00000216554
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDLHVNPKKQTIGNSCKACGYRGMLDTHHKLCTFILKNPPENSDSGTGKKEKEKKNRKGKDKENGSVSSSETPPPPPPPNEINPPPHTMEEEEDDDWGEDTTEEAQRRRMDEISDHAKVLTLSDDLERTIEERVNILFDFVKKKKEEGVIDSSDKEIVAEAERLDVKAMGPLVLTEVLFNEKIREQIKKYRRHFLRFCHNNKKAQRYLLHGLECVVAMHQAQLISKIPHILKEMYDADLLEEEVIISWSEKASKKYVSKELAKEIRVKAEPFIKWLKEAEEESSGGEEEDEDENIEVVYSKAASVPKVETVKSDNKDDDIDIDAI

SEQ ID NO: 28914 - protein, 431 aa, Homo sapiens; identical to SEQ ID NO: 28913
  Payload ID: 5637
  Gene Symbol: EIF5
  Gene Name: eukaryotic translation initiation factor 5
  Uniprot ID: P55010
  ENSP ID: ENSP00000376477

SEQ ID NO: 28915 - protein, 68 aa, Homo sapiens
  Payload ID: 5637
  Gene Symbol: EIF5
  Gene Name: eukaryotic translation initiation factor 5
  ENSP ID: ENSP00000452615
MSVNVNRSVSDQFYRYKMPRLIAKVEGKGNGIKTVIVNMVDVAKALNRPPTYPTKYFGCELGAQTQFD

SEQ ID NO: 28916 - protein, 51 aa, Homo sapiens
  Payload ID: 5637
  Gene Symbol: EIF5
  Gene Name: eukaryotic translation initiation factor 5
  ENSP ID: ENSP00000452636
MSVNVNRSVSDQFYRYKMPRLIAKVEGKGNGIKTVIVNMVDVAKALNRPPT

SEQ ID NO: 28917 - protein, 109 aa, Homo sapiens
  Payload ID: 5637
  Gene Symbol: EIF5
  Gene Name: eukaryotic translation initiation factor 5
  ENSP ID: ENSP00000452883
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDL

SEQ ID NO: 28918 - protein, 146 aa, Homo sapiens
  Payload ID: 5637
  Gene Symbol: EIF5
  Gene Name: eukaryotic translation initiation factor 5
  ENSP ID: ENSP00000453396
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDLHVNPKKQTIGNSCKACGYRGMLDTHHKLCTFILKNPP

SEQ ID NO: 28919 - protein, 109 aa, Homo sapiens; identical to SEQ ID NO: 28917
  Payload ID: 5637
  Gene Symbol: EIF5
  Gene Name: eukaryotic translation initiation factor 5
  ENSP ID: ENSP00000453468

SEQ ID NO: 28920 - protein, 101 aa, Homo sapiens
  Payload ID: 5637
  Gene Symbol: EIF5
  Gene Name: eukaryotic translation initiation factor 5
  ENSP ID: ENSP00000453633
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPE

SEQ ID NO: 28921 - protein, 431 aa, Homo sapiens; identical to SEQ ID NO: 28913
  Payload ID: 5637
  Gene Symbol: EIF5
  Gene Name: eukaryotic translation initiation factor 5
  Uniprot ID: P55010
  ENSP ID: ENSP00000453743

SEQ ID NO: 28922 - protein, 200 aa, Homo sapiens
  Payload ID: 5637
  Gene Symbol: EIF5
  Gene Name: eukaryotic translation initiation factor 5
  ENSP ID: ENSP00000453856
MSVNVNRSVSDQFYRYKMPRLIAKVEGKGNGIKTVIVNMVDVAKALNRPPTYPTKYFGCELGAQTQFDVKNDRYIVNGSHEANKLQDMLDGFIKKFVLCPECENPETDLHVNPKKQTIGNSCKACGYRGMLDTHHKLCTFILKNPPENSDSGTGKKEKEKKNRKGKDKENGSVSSSETPPPPPPPNEINPPPHTMEEEED

SEQ ID NO: 28923 - protein, 184 aa, Homo sapiens
  Payload ID: 5638
  Gene Symbol: EIF5A
  Gene Name: eukaryotic translation initiation factor 5A
  Uniprot ID: P63241
  ENSP ID: ENSP00000336702
MCGTGGTDSKTRRPPHRASFLKRLESKPLKMADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAK

SEQ ID NO: 28924 - protein, 154 aa, Homo sapiens
  Payload ID: 5638
  Gene Symbol: EIF5A
  Gene Name: eukaryotic translation initiation factor 5A
  Uniprot ID: P63241
  ENSP ID: ENSP00000336776
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAK

SEQ ID NO: 28925 - protein, 154 aa, Homo sapiens; identical to SEQ ID NO: 28924
  Payload ID: 5638
  Gene Symbol: EIF5A
  Gene Name: eukaryotic translation initiation factor 5A
  Uniprot ID: P63241
  ENSP ID: ENSP00000390677

SEQ ID NO: 28926 - protein, 154 aa, Homo sapiens; identical to SEQ ID NO: 28924
  Payload ID: 5638
  Gene Symbol: EIF5A
  Gene Name: eukaryotic translation initiation factor 5A
  Uniprot ID: P63241
  ENSP ID: ENSP00000396073

SEQ ID NO: 28927 - protein, 154 aa, Homo sapiens; identical to SEQ ID NO: 28924
  Payload ID: 5638
  Gene Symbol: EIF5A
  Gene Name: eukaryotic translation initiation factor 5A
  Uniprot ID: P63241
  ENSP ID: ENSP00000458269

SEQ ID NO: 28928 - protein, 154 aa, Homo sapiens; identical to SEQ ID NO: 28924
  Payload ID: 5638
  Gene Symbol: EIF5A
  Gene Name: eukaryotic translation initiation factor 5A
  Uniprot ID: P63241
  ENSP ID: ENSP00000459196

SEQ ID NO: 28929 - protein, 154 aa, Homo sapiens; identical to SEQ ID NO: 28924
  Payload ID: 5638
  Gene Symbol: EIF5A
  Gene Name: eukaryotic translation initiation factor 5A
  Uniprot ID: P63241
  ENSP ID: ENSP00000459611

SEQ ID NO: 28930 - protein, 146 aa, Homo sapiens
  Payload ID: 5638
  Gene Symbol: EIF5A
  Gene Name: eukaryotic translation initiation factor 5A
  ENSP ID: ENSP00000460284
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAA

SEQ ID NO: 28931 - protein, 186 aa, Homo sapiens
  Payload ID: 5638
  Gene Symbol: EIF5A
  Gene Name: eukaryotic translation initiation factor 5A
  ENSP ID: ENSP00000461688
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILVWCLPPCFCAQLCSVRFFLSSDISWLSLLLLQITVLSAMTEEAAVAIKAMAK

SEQ ID NO: 28932 - protein, 153 aa, Homo sapiens
  Payload ID: 5639
  Gene Symbol: EIF5A2
  Gene Name: eukaryotic translation initiation factor 5A2
  Uniprot ID: Q9GZV4
  ENSP ID: ENSP00000295822
MADEIDFTTGDAGASSTYPMQCSALRKNGFVVLKGRPCKIVEMSTSKTGKHGHAKVHLVGIDIFTGKKYEDICPSTHNMDVPNIKRNDYQLICIQDGYLSLLTETGEVREDLKLPEGELGKEIEGKYNAGEDVQVSVMCAMSEEYAVAIKPCK

SEQ ID NO: 28933 - protein, 115 aa, Homo sapiens
  Payload ID: 5639
  Gene Symbol: EIF5A2
  Gene Name: eukaryotic translation initiation factor 5A2
  ENSP ID: ENSP00000417133
MQCSALRKNGFVVLKGRPCKIVEMSTSKTGKHGHAKVHLVGIDIFTGKKYEDICPSTHNMDVPNIKRNDYQLICIQDGYLSLLTETGEVREDLKLPEGELGKEIEGKYNAGEDVQ

SEQ ID NO: 28934 - protein, 109 aa, Homo sapiens
  Payload ID: 5639
  Gene Symbol: EIF5A2
  Gene Name: eukaryotic translation initiation factor 5A2
  ENSP ID: ENSP00000418305
MADEIDFTTGDAGASSTYPMQCSALRKNGFVVLKGRPCKIVEMSTSKTGKHGHAKVHLVGIDIFTGKKYEDICPSTHNMDVPNIKRNDYQVSVMCAMSEEYAVAIKPCK

SEQ ID NO: 28935 - protein, 105 aa, Homo sapiens
  Payload ID: 5639
  Gene Symbol: EIF5A2
  Gene Name: eukaryotic translation initiation factor 5A2
  ENSP ID: ENSP00000418370
MADEIDFTTGDAGASSTYPMQCSALRKNGFVVLKGRPCKIVEMSTSKTGKHGHAKVHLVGIDIFTGKKYEDICPSTHNMDVPNIKRNDYQKLVKFVRILNCQKVN

SEQ ID NO: 28936 - protein, 154 aa, Homo sapiens
  Payload ID: 5640
  Gene Symbol: EIF5AL1
  Gene Name: eukaryotic translation initiation factor 5A-like 1
  Uniprot ID: Q6IS14
  ENSP ID: ENSP00000430706
MADDLDFETGDAGASATFPMQCSALRKNGFVVLKGWPCKIVEMSASKTGKHGHAKVHLVGIDIFTGKKYEDICPSTHNMDVPNIKRNDFQLIGIQDGYLSLLQDSGEVPEDLRLPEGDLGKEIEQKYDCGEEILITVLSAMTEEAAVAIKAMAK

SEQ ID NO: 28937 - protein, 1220 aa, Homo sapiens
  Payload ID: 5641
  Gene Symbol: EIF5B
  Gene Name: eukaryotic translation initiation factor 5B
  Uniprot ID: O60841
  ENSP ID: ENSP00000289371
MGKKQKNKSEDSTKDDIDLDALAAEIEGAGAAKEQEPQKSKGKKKKEKKKQDFDEDDILKELEELSLEAQGIKADRETVAVKPTENNEEEFTSKDKKKKGQKGKKQSFDDNDSEELEDKDSKSKKTAKPKVEMYSGSDDDDDFNKLPKKAKGKAQKSNKKWDGSEEDEDNSKKIKERSRINSSGESGDESDEFLQSRKGQKKNQKNKPGPNIESGNEDDDASFKIKTVAQKKAEKKERERKKRDEEKAKLRKLKEKEELETGKKDQSKQKESQRKFEEETVKSKVTVDTGVIPASEEKAETPTAAEDDNEGDKKKKDKKKKKGEKEEKEKEKKKGPSKATVKAMQEALAKLKEEEERQKREEEERIKRLEELEAKRKEEERLEQEKRERKKQKEKERKERLKKEGKLLTKSQREARARAEATLKLLQAQGVEVPSKDSLPKKRPIYEDKKRKKIPQQLESKEVSESMELCAAVEVMEQGVPEKEETPPPVEPEEEEDTEDAGLDDWEAMASDEETEKVEGNKVHIEVKENPEEEEEEEEEEEEDEESEEEEEEEGESEGSEGDEEDEKVSDEKDSGKTLDKKPSKEMSSDSEYDSDDDRTKEERAYDKAKRRIEKRRLEHSKNVNTEKLRAPIICVLGHVDTGKTKILDKLRHTHVQDGEAGGITQQIGATNVPLEAINEQTKMIKNFDRENVRIPGMLIIDTPGHESFSNLRNRGSSLCDIAILVVDIMHGLEPQTIESINLLKSKKCPFIVALNKIDRLYDWKKSPDSDVAATLKKQKKNTKDEFEERAKAIIVEFAQQGLNAALFYENKDPRTFVSLVPTSAHTGDGMGSLIYLLVELTQTMLSKRLAHCEELRAQVMEVKALPGMGTTIDVILINGRLKEGDTIIVPGVEGPIVTQIRGLLLPPPMKELRVKNQYEKHKEVEAAQGVKILGKDLEKTLAGLPLLVAYKEDEIPVLKDELIHELKQTLNAIKLEEKGVYVQASTLGSLEALLEFLKTSEVPYAGINIGPVHKKDVMKASVMLEHDPQYAVILAFDVRIERDAQEMADSLGVRIFSAEIIYHLFDAFTKYRQDYKKQKQEEFKHIAVFPCKIKILPQYIFNSRDPIVMGVTVEAGQVKQGTPMCVPSKNFVDIGIVTSIEINHKQVDVAKKGQEVCVKIEPIPGESPKMFGRHFEATDILVSKISRQSIDALKDWFRDEMQKSDWQLIVELKKVFEII

SEQ ID NO: 28938 - protein, 1220 aa, Homo sapiens [sequence omitted]

SEQ ID NO: 28939 - protein, 245 aa, Homo sapiens
  Payload ID: 5642
  Gene Symbol: EIF6
  Gene Name: eukaryotic translation initiation factor 6
  Uniprot ID: P56537
  ENSP ID: ENSP00000363559
MAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVTTCNDYVALVHPDLDRETEEILADVLKVEVFRQTVADQVLVGSYCVFSNQGGLVHPKTSIEDQDELSSLLQVPLVAGTVNRGSEVIAAGMVVNDWCAFCGLDTTSTELSVVESVFKLNEAQPSTIATSMRDSLIDSLT

SEQ ID NO: 28940 - protein, 226 aa, Homo sapiens
  Payload ID: 5642
  Gene Symbol: EIF6
  Gene Name: eukaryotic translation initiation factor 6
  Uniprot ID: P56537
  ENSP ID: ENSP00000363566
MAVRASFENNCEIGCFAKLTNTYCLVAIGGSENFYRCGGSPGAYGGGEACAGVKSSGSGRVPAPLPRHHRVHVPTVCSRASSPIPSPWCTRLSPAAASSGACVWETEEILADVLKVEVFRQTVADQVLVGSYCVFSNQGGLVHPKTSIEDQDELSSLLQVPLVAGTVNRGSEVIAAGMVVNDWCAFCGLDTTSTELSVVESVFKLNEAQPSTIATSMRDSLIDSLT

SEQ ID NO: 28941 - protein, 245 aa, Homo sapiens; identical to SEQ ID NO: 28939
  Payload ID: 5642
  Gene Symbol: EIF6
  Gene Name: eukaryotic translation initiation factor 6
  Uniprot ID: P56537
  ENSP ID: ENSP00000363574

SEQ ID NO: 28942 - protein, 108 aa, Homo sapiens
  Payload ID: 5642
  Gene Symbol: EIF6
  Gene Name: eukaryotic translation initiation factor 6
  ENSP ID: ENSP00000390897
MAVRASFENNCEIGCFAKLTNTYCLVAIGGSENFYSVFEGELSDTIPVVHASIAGCRIIGRMCVGNRHGLLVPNNTTDQELQHIRNSLPDTVQIRRVEERLSALGNVT

SEQ ID NO: 28943 - protein, 59 aa, Homo sapiens
  Payload ID: 5642
  Gene Symbol: EIF6
  Gene Name: eukaryotic translation initiation factor 6
  ENSP ID: ENSP00000395907
MAVRASFENNCEIGCFAKLTNTYCLVAIGGSENFYRRQKKFWQMCSRWKSSDRQWPTRC

SEQ ID NO: 28944 - protein, 108 aa, Homo sapiens
  Payload ID: 5642
  Gene Symbol: EIF6
  Gene Name: eukaryotic translation initiation factor 6
  ENSP ID: ENSP00000411450
MAVRASFENNCEIGCFAKLTNTYCLVAIGGSENFYSVFEGELSDTIPVVHASIAGCRIIGRMCVGDRRNSGRCAQGGSLQTDSGRPGASRKLLCLQQSGRAGASQDFN

SEQ ID NO: 28945 - protein, 186 aa, Homo sapiens
  Payload ID: 5642
  Gene Symbol: EIF6
  Gene Name: eukaryotic translation initiation factor 6
  ENSP ID: ENSP00000415044
MAVRASFENNCEIGCFAKLTNTYCLVAIGGSENFYRCGGSPGAYGGGEACAGVKSSGSGRVPAPLPRHHRVHVPTVCSRASSPIPSPWCTRLSPAAASSGACVWGTGTVSWYPTIPPTRSCNTFATASQTQCRLGGWRSGSQPWAMSPPAMTTWPWSTQTWTGRQKKFWQMCSRWKSSDRQWPTRC

SEQ ID NO: 28946 - protein, 245 aa, Homo sapiens; identical to SEQ ID NO: 28939
  Payload ID: 5642
  Gene Symbol: EIF6
  Gene Name: eukaryotic translation initiation factor 6
  Uniprot ID: P56537
  ENSP ID: ENSP00000483289

SEQ ID NO: 28947 - protein, 437 aa, Homo sapiens
  Payload ID: 5643
  Gene Symbol: ETF1
  Gene Name: eukaryotic translation termination factor 1
  Uniprot ID: P62495
  ENSP ID: ENSP00000353741
MADDPSAADRNVEIWKIKKLIKSLEAARGNGTSMISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 28948 - protein, 404 aa, Homo sapiens
  Payload ID: 5643
  Gene Symbol: ETF1
  Gene Name: eukaryotic translation termination factor 1
  Uniprot ID: P62495
  ENSP ID: ENSP00000421288
MISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 28949 - protein, 423 aa, Homo sapiens
  Payload ID: 5643
  Gene Symbol: ETF1
  Gene Name: eukaryotic translation termination factor 1
  ENSP ID: ENSP00000422203
MKQDVLNCTEGPIHSNGTSMISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 28950 - protein, 95 aa, Homo sapiens
  Payload ID: 5643
  Gene Symbol: ETF1
  Gene Name: eukaryotic translation termination factor 1
  ENSP ID: ENSP00000422272
MADDPSAADRNVEIWKIKKLIKSLEAARGNGTSMISLIIPPKDQISRVAKMLADEFGTASNIKSRVNRLSVLGAITSVQQRLKLYNKGSYSTTFR

SEQ ID NO: 28951 - protein, 119 aa, Homo sapiens
  Payload ID: 5643
  Gene Symbol: ETF1
  Gene Name: eukaryotic translation termination factor 1
  ENSP ID: ENSP00000425689
MISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVID

SEQ ID NO: 28952 - protein, 208 aa, Homo sapiens
  Payload ID: 5643
  Gene Symbol: ETF1
  Gene Name: eukaryotic translation termination factor 1
  ENSP ID: ENSP00000461082
MISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDM

SEQ ID NO: 28953 - protein, 152 aa, Homo sapiens
  Payload ID: 5644
  Gene Symbol: EVA1A
  Gene Name: eva-1 homolog A (C. elegans)
  Uniprot ID: Q9H8M9
  ENSP ID: ENSP00000233712
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEVPGTRSLNRYY

SEQ ID NO: 28954 - protein, 152 aa, Homo sapiens; identical to SEQ ID NO: 28953
  Payload ID: 5644
  Gene Symbol: EVA1A
  Gene Name: eva-1 homolog A (C. elegans)
  Uniprot ID: Q9H8M9
  ENSP ID: ENSP00000377490

SEQ ID NO: 28955 - protein, 152 aa, Homo sapiens; identical to SEQ ID NO: 28953
  Payload ID: 5644
  Gene Symbol: EVA1A
  Gene Name: eva-1 homolog A (C. elegans)
  Uniprot ID: Q9H8M9
  ENSP ID: ENSP00000386435

SEQ ID NO: 28956 - protein, 140 aa, Homo sapiens
  Payload ID: 5644
  Gene Symbol: EVA1A
  Gene Name: eva-1 homolog A (C. elegans)
  ENSP ID: ENSP00000386835
MKGSKSFVLQKMFSCSKNPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEVPGTRSLNRYY

SEQ ID NO: 28957 - protein, 152 aa, Homo sapiens; identical to SEQ ID NO: 28953
  Payload ID: 5644
  Gene Symbol: EVA1A
  Gene Name: eva-1 homolog A (C. elegans)
  Uniprot ID: Q9H8M9
  ENSP ID: ENSP00000386930

SEQ ID NO: 28958 - protein, 101 aa, Homo sapiens
  Payload ID: 5644
  Gene Symbol: EVA1A
  Gene Name: eva-1 homolog A (C. elegans)
  ENSP ID: ENSP00000388105
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHR

SEQ ID NO: 28959 - protein, 142 aa, Homo sapiens
  Payload ID: 5644
  Gene Symbol: EVA1A
  Gene Name: eva-1 homolog A (C. elegans)
  ENSP ID: ENSP00000398249
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEV

SEQ ID NO: 28960 - protein, 165 aa, Homo sapiens
  Payload ID: 5645
  Gene Symbol: EVA1B
  Gene Name: eva-1 homolog B (C. elegans)
  Uniprot ID: Q9NVM1
  ENSP ID: ENSP00000270824
MDAPRRDMELLSNSLAAYAHIRANPESFGLYFVLGVCFGLLLTLCLLVISISWAPRPRPRGPAQRRDPRSSTLEPEDDDEDEEDTVTRLGPDDTLPGPELSAEPDGPLNVNVFTSAEELERAQRLEERERILREIWRTGQPDLLGTGTLGPSPTATGTLGRMHYY

SEQ ID NO: 28961 - protein, 441 aa, Homo sapiens
  Payload ID: 5646
  Gene Symbol: EVA1C
  Gene Name: eva-1 homolog C (C. elegans)
  Uniprot ID: P58658
  ENSP ID: ENSP00000300255
MLLPGRARQPPTPQPVQHPGLRRQVEPPGQLLRLFYCTVLVCSKEISALTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLKPSLKQKDGEYGINFDPSGSKVLRKDGILVSNSLAAFAYIRAHPERAALLFVSSVCIGLALTLCALVIRESCAKDFRDLQLGREQLVPGSDKVEEDSEDEEEEEDPSESDFPGELSGFCRTSYPIYSSIEAAELAERIERREQIIQEIWMNSGLDTSLPRNMGQFY

SEQ ID NO: 28962 - protein, 438 aa, Homo sapiens
  Payload ID: 5646
  Gene Symbol: EVA1C
  Gene Name: eva-1 homolog C (C. elegans)
  Uniprot ID: P58658
  ENSP ID: ENSP00000372146
MLLPGRARQPPTPQPVQHPGLRRQVEPPGQLLRLFYCTVLVCSKEISALTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLKPSLKQKDGINFDPSGSKVLRKDGILVSNSLAAFAYIRAHPERAALLFVSSVCIGLALTLCALVIRESCAKDFRDLQLGREQLVPGSDKVEEDSEDEEEEEDPSESDFPGELSGFCRTSYPIYSSIEAAELAERIERREQIIQEIWMNSGLDTSLPRNMGQFY

SEQ ID NO: 28963 - protein, 393 aa, Homo sapiens
  Payload ID: 5646
  Gene Symbol: EVA1C
  Gene Name: eva-1 homolog C (C. elegans)
  ENSP ID: ENSP00000384594
MLLPGRARQPPTPQPVQHPGLRRQVEPPGQLLRLFYCTVLVCSKEISALTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFVPKNILTAIDPAIANLKPSLKQKDGEYGINFDPSGSKVLRKDGILVSNSLAAFAYIRAHPERAALLFVSSVCIGLALTLCALVIRESCAKDFRDLQLGREQLVPGSDKVEEDSEDEEEEEDPSESDFPGELSGFCRTSYPIYSSIEAAELAERIERREQIIQEIWMNSGLDTSLPRNMGQFY

SEQ ID NO: 28964 - protein, 153 aa, Homo sapiens
  Payload ID: 5646
  Gene Symbol: EVA1C
  Gene Name: eva-1 homolog C (C. elegans)
  ENSP ID: ENSP00000389269
MCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPG

SEQ ID NO: 28965 - protein, 70 aa, Homo sapiens
  Payload ID: 5646
  Gene Symbol: EVA1C
  Gene Name: eva-1 homolog C (C. elegans)
  ENSP ID: ENSP00000389291
MLLPGRARQPPTPQPVQHPGLRRQVEPPGQLLRLFYCTVLVCSKEISALTDFSEGAGRMPEPAGLPPPGQ

SEQ ID NO: 28966 - protein, 192 aa, Homo sapiens
  Payload ID: 5646
  Gene Symbol: EVA1C
  Gene Name: eva-1 homolog C (C. elegans)
  ENSP ID: ENSP00000401547
MLLPGRARQPPTPQPVQHPGLRRQVEPPGQLLRLFYCTVLVCSKEISALTDFSDELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLKPSLKQKDGEYGNFYGLLPAFLFK

SEQ ID NO: 28967 - protein, 70 aa, Homo sapiens; identical to SEQ ID NO: 28965
  Payload ID: 5646
  Gene Symbol: EVA1C
  Gene Name: eva-1 homolog C (C. elegans)
  ENSP ID: ENSP00000407190

SEQ ID NO: 28968 - protein, 201 aa, Homo sapiens
  Payload ID: 5647
  Gene Symbol: EVX1
  Gene Name: even-skipped homeobox 1
  ENSP ID: ENSP00000222761
MESRKDMVVFLDGGQLGTLVGKRVSNLSEAVGSPLPEPPEKMVPRGCLSPRAVPPATRERGGGGPEEEPVDGLAGSAAGPGAEPQVAGAAMLGPGPPAPSVDSLSGQGQPSSSDTESDFYEEIEGPAPRRWSAVRTEGARPPRATAAVVGAARKAPWRAAPVTRCVVTAPPSPESRLRGWRRNSTGRTTYPGRGDVSWRPP

SEQ ID NO: 28969 - protein, 407 aa, Homo sapiens
  Payload ID: 5647
  Gene Symbol: EVX1
  Gene Name: even-skipped homeobox 1
  Uniprot ID: P49640
  ENSP ID: ENSP00000419266
MESRKDMVVFLDGGQLGTLVGKRVSNLSEAVGSPLPEPPEKMVPRGCLSPRAVPPATRERGGGGPEEEPVDGLAGSAAGPGAEPQVAGAAMLGPGPPAPSVDSLSGQGQPSSSDTESDFYEEIEVSCTPDCATGNAEYQHSKGSGSEALVGSPNGGSETPKSNGGSGGGGSQGTLACSASDQMRRYRTAFTREQIARLEKEFYRENYVSRPRRCELAAALNLPETTIKVWFQNRRMKDKRQRLAMTWPHPADPAFYTYMMSHAAAAGGLPYPFPSHLPLPYYSPVGLGAASAASAAASPFSGSLRPLDTFRVLSQPYPRPELLCAFRHPPLYPGPAHGLGASAGGPCSCLACHSGPANGLAPRAAAASDFTCASTSRSDSFLTFAPSVLSKASSVALDQREEVPLTR

SEQ ID NO: 28970 - protein, 106 aa, Homo sapiens
  Payload ID: 5647
  Gene Symbol: EVX1
  Gene Name: even-skipped homeobox 1
  ENSP ID: ENSP00000463759
RTPSRISMKKSSLLPITLRTTWTPLTYTKGPAPRRWSAVRTEGARPPRATAAVVGAARKAPWRAAPVTRCVVTAPPSPESRLRGWRRNSTGRTTYPGRGDVSWRPP

SEQ ID NO: 28971 - protein, 476 aa, Homo sapiens
  Payload ID: 5648
  Gene Symbol: EVX2
  Gene Name: even-skipped homeobox 2
  Uniprot ID: Q03828
  ENSP ID: ENSP00000312385
MMERIRKEMILMERGLHSPTAGKRFSNLSNSAGNAVLEALENSQHPARLSPRLPSAPLHSALGELPAKGKFEIDTLFNLQHTGSESTVSSEISSAAESRKKPGHYSEAAAEADMSSDVEVGCSALRSPGGLGAAQLKENNGKGYAESGSAAGTTTSASGSGLGSLHGGSGGSGGSAALGGSGSGADQVRRYRTAFTREQIARLEKEFYRENYVSRPRRCELAAALNLPETTIKVWFQNRRMKDKRQRLAMSWPHPADPSFYTYMMTHAAATGSLPYPFHSHVPLHYYPHVGVTAAAAAAAASGAAAAASSPFATSIRPLDTFRALSHPYSRPELLCSFRHPGLYQAPAAAAGLNSAASAAAAAAAAAAAASSAAAAGAPPSGGSAPCSCLSCHSSQSAAAAAAAAAAALGSRGGGGGGGGGGGGGGGGAGAGGGSDFGCSAAAPRSESGFLPYSAAVLSKTAVSPPDQRDEAPLTR

SEQ ID NO: 28972 - protein, 926 aa, Homo sapiens
  Payload ID: 5649
  Gene Symbol: ETAA1
  Gene Name: Ewing tumor-associated antigen 1
  Uniprot ID: Q9NY74
  ENSP ID: ENSP00000272342
MSRRRKHDDSPSPKKTPHKTVAAEECGSVVEPGRRRLRSARGSWPCGAREGPPGPVRQREQPPTAALCSKSNPEERYETPKRALKMDSLSSSFSSPNDPDGQNDIFWDQNSPLTKQLGKGRKKQIYTTDSDEISHIVNRIAPQDEKPTTNSMLDMWIGETAIPCTPSVAKGKSRAKISCTKLKTQSQEEELMKLAKQFDKNMEELDVIQEQNKRNYDFTQMISETEILSNYKDNIQMWSLHNIVPEIDNATKKPIKGNTKISVANNQNSSQKPFDQIAEAAFNAIFDGSTQKCSGQLSQELPEAFWSTSNTTFVKTNALKEEKIITNETLVIEKLSNKTPRSLSSQVDTPIMTKSCVTSCTKEPETSNKYIDAFTTSDFEDDWENLLGSEPFAMQNIDMPELFPSKTAHVTDQKEICTFNSKTVKNTSRANTSPDARLGDSKVLQDLSSKTYDRELIDAEYRFSPNSNKSNKLSTGNKMKFENSSNKIVIQDEIQNCIVTSNLTKIKEDILTNSTEASERKSALNTRYSNEQKNKCILNQSIKAPVNTDLFGSANLGSKTSVSNPNQTSASKVGSFFDDWNDPSFANEIIKACHQLDNTWEADDVDDDLLYQACDDIERLTQQQDIRKDSKTSESICEINNNSEHGAKLTQQQDIRKDSKTSESICEINNNSEHGAKNMFAISKQGSNLVQSKHLNPGSISVQTSLTNSSQIDKPMKMEKGEMYGNSPRFLGATNLTMYSKISNCQINNLHVSYTNTDVPIQVNSSKLVLPGSSSLNVTSDHMNTEITTYKKKLSTNQPCHKTVTDEAQSNLNTTVGFSKFTFTRMKNSQILSQFNQNCITGSMSDTKITQGVEKKKGVNPLLEEAVGQQSLVKLSESLKQSSKEEEEKNRKCSPEEIQRKRQEALVRRMAKARASSVNAAPTSFL

SEQ ID NO: 28973 - protein, 354 aa, Homo sapiens
  Payload ID: 5650
  Gene Symbol: EWSR1
  Gene Name: EWS RNA-binding protein 1
  Uniprot ID: Q01844
  ENSP ID: ENSP00000327456
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGLQSESLVYTSILKKYPYSVLSRQHNEKWD

SEQ ID NO: 28974 - protein, 618 aa, Homo sapiens
  Payload ID: 5650
  Gene Symbol: EWSR1
  Gene Name: EWS RNA-binding protein 1
  ENSP ID: ENSP00000330516
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 28975 - protein, 620 aa, Homo sapiens
  Payload ID: 5650
  Gene Symbol: EWSR1
  Gene Name: EWS RNA-binding protein 1
  ENSP ID: ENSP00000330896
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQIYFVGSGRTKNGFETRAFSSLHGFQSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 28976 - protein, 600 aa, Homo sapiens
  Payload ID: 5650
  Gene Symbol: EWSR1
  Gene Name: EWS RNA-binding protein 1
  Uniprot ID: Q01844
  ENSP ID: ENSP00000331699
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 28977 - protein, 308 aa, Homo sapiens
  Payload ID: 5650
  Gene Symbol: EWSR1
  Gene Name: EWS RNA-binding protein 1
  ENSP ID: ENSP00000353204
  MOD_RES (1)..(1): Any amino acid
XLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPSIGDFCCDVIVCRGCGNQNFAWRTECNQCGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 28978 - protein, 656 aa, Homo sapiens
  Payload ID: 5650
  Gene Symbol: EWSR1
  Gene Name: EWS RNA-binding protein 1
  Uniprot ID: Q01844
  ENSP ID: ENSP00000381031
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 28979 - protein, 655 aa, Homo sapiens
  Payload ID: 5650
  Gene Symbol: EWSR1
  Gene Name: EWS RNA-binding protein 1
  Uniprot ID: Q01844
  ENSP ID: ENSP00000385726
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 28980 - protein, 233 aa, Homo sapiens
  Payload ID: 5650
  Gene Symbol: EWSR1
  Gene Name: EWS RNA-binding protein 1
  ENSP ID: ENSP00000393637
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPG

SEQ ID NO: 28981 - protein, 180 aa, Homo sapiens
  Payload ID: 5650
  Gene Symbol: EWSR1
  Gene Name: EWS RNA-binding protein 1
  ENSP ID: ENSP00000395200
MASTDYSTYSQAAAQQGYSAYTAQPTQGYAQTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYS

SEQ ID NO: 28982 - protein, 661 aa, Homo sapiens
  Payload ID: 5650
  Gene Symbol: EWSR1
  Gene Name: EWS RNA-binding protein 1
  Uniprot ID: Q01844
  ENSP ID: ENSP00000400142
MASTDYSTYSQAAAQQGYSAYTAQPTQGYAQTTQAYGQQSYGTYGQPTDVSYTQAQTTATYGQTAYATSYGQPPTVEGTSTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 28983 - protein, 166 aa, Homo sapiens
  Payload ID: 5650
  Gene Symbol: EWSR1
  Gene Name: EWS RNA-binding protein 1
  ENSP ID: ENSP00000405947
MASTDYSTYSQAAAQQGYSAYTAQPTQGYAQTTQQAYGQQSYGTYGQPTDVSYTQAQTTATYGQTAYATSYGQPPTEGTSTGYTTPTAPQAYSQPVQGYGTGAYDTTTATVTTTQASYAAQSAYGTQPAYPAYGQQPAATAPTRPQDGNKPTETSQPQSSTGGYNQ

SEQ ID NO: 28984 - protein, 156 aa, Homo sapiens
  Payload ID: 5650
  Gene Symbol: EWSR1
  Gene Name: EWS RNA-binding protein 1
  ENSP ID: ENSP00000406824
MASTDYSTYSQAAAQQGYSAYTAQPTQGYAQTTQQAYGQQSYGTYGQPTDVSYTQAQTTATYGQTAYATSYGQPPTVEGTSTGYTTPTAPQAYSQPVQGYGTGAYDTTTATVTTTQASYAAQSAYGTQPAYPAYGQQPAATAPTRPQDGNKPTETS

SEQ ID NO: 28985 - protein, 292 aa, Homo sapiens
  Payload ID: 5650
  Gene Symbol: EWSR1
  Gene Name: EWS RNA-binding protein 1
  ENSP ID: ENSP00000412670
MASTDYSTYSQAAAQQGYSAYTAQPTQGYAQTTQQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGEN

SEQ ID NO: 28986 - protein, 77 aa, Homo sapiens
  Payload ID: 5650
  Gene Symbol: EWSR1
  Gene Name: EWS RNA-binding protein 1
  ENSP ID: ENSP00000416171
MASTDYSTYSQAAAQQGAYTAQPTQGYAQTTQAYGQQSYGTYGQPTDVSYTQAQTTATYGQTAYATSYGQPPTGYTT

SEQ ID NO: 28987 - protein, 584 aa, Homo sapiens
  Payload ID: 5650
  Gene Symbol: EWSR1
  Gene Name: EWS RNA-binding protein 1
  ENSP ID: ENSP00000486709
MASTDYSTYSQAAAQQGYSAYTAQPTQGYAQTTQQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQRPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 28988 - protein, 323 aa, Homo sapiens
  Payload ID: 5651
  Gene Symbol: ERCC1
  Gene Name: excision repair cross-complementation group 1
  Uniprot ID: P07992
  ENSP ID: ENSP00000013807
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKVRALGKNPRSWGKERAPNKHNLRPQSFKVKKEPKTRHSGFRL

SEQ ID NO: 28989 - protein, 297 aa, Homo sapiens
  Payload ID: 5651
  Gene Symbol: ERCC1
  Gene Name: excision repair cross-complementation group 1
  Uniprot ID: P07992
  ENSP ID: ENSP00000300853
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 28990 - protein, 273 aa, Homo sapiens
  Payload ID: 5651
  Gene Symbol: ERCC1
  Gene Name: excision repair cross-complementation group 1
  Uniprot ID: P07992
  ENSP ID: ENSP00000345203
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRSLEQLIAASREDLALCPGLGPQKARRLFDVLHEPFLKVP

SEQ ID NO: 28991 - protein, 225 aa, Homo sapiens
  Payload ID: 5651
  Gene Symbol: ERCC1
  Gene Name: excision repair cross-complementation group 1
  Uniprot ID: P07992
  ENSP ID: ENSP00000394875
MDPGKDKEGVPQPSGPPARKKFVIPLDEDEVPPGVRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 28992 - protein, 45 aa, Homo sapiens
  Payload ID: 5651
  Gene Symbol: ERCC1
  Gene Name: excision repair cross-complementation group 1
  ENSP ID: ENSP00000465225
FGDVIPDYVLGQSTCALFLRAPGTCSPLEAQVSSPLHEEARGLVF

SEQ ID NO: 28993 - protein, 112 aa, Homo sapiens
  Payload ID: 5651
  Gene Symbol: ERCC1
  Gene Name: excision repair cross-complementation group 1
  ENSP ID: ENSP00000465354
  MOD_RES (1)..(1): Any amino acid
XCILADCTLILAWSPEEAGRYLETYKAYEQKPADLLMEKLEQDFVSRSLEQLIAASREDLALCPGLGPQKVRALGKNPRSWGKERAPNKHNLRPQSFKVKKEPKTRHSGFRL

SEQ ID NO: 28994 - protein, 141 aa, Homo sapiens
  Payload ID: 5651
  Gene Symbol: ERCC1
  Gene Name: excision repair cross-complementation group 1
  ENSP ID: ENSP00000465524
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFL

SEQ ID NO: 28995 - protein, 91 aa, Homo sapiens
  Payload ID: 5651
  Gene Symbol: ERCC1
  Gene Name: excision repair cross-complementation group 1
  ENSP ID: ENSP00000466644
  MOD_RES (1)..(1): Any amino acid
XNLHPDYIHGRLQSLGKNFALRVLLVQVDVKDPQQALKELAKMCILADCTLILAWSLWNSSSPHQEKIWPYAQAWALRKPGGCLMSCTSPS

SEQ ID NO: 28996 - protein, 258 aa, Homo sapiens
  Payload ID: 5651
  Gene Symbol: ERCC1
  Gene Name: excision repair cross-complementation group 1
  ENSP ID: ENSP00000467183
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFG

SEQ ID NO: 28997 - protein, 297 aa, Homo sapiens; identical to SEQ ID NO: 28989
  Payload ID: 5651
  Gene Symbol: ERCC1
  Gene Name: excision repair cross-complementation group 1
  Uniprot ID: P07992
  ENSP ID: ENSP00000468035

SEQ ID NO: 28998 - protein, 213 aa, Homo sapiens
  Payload ID: 5651
  Gene Symbol: ERCC1
  Gene Name: excision repair cross-complementation group 1
  ENSP ID: ENSP00000468119
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWRPGGCLMSCTSPS

SEQ ID NO: 28999 - protein, 234 aa, Homo sapiens
  Payload ID: 5651
  Gene Symbol: ERCC1
  Gene Name: excision repair cross-complementation group 1
  ENSP ID: ENSP00000468158
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSR

SEQ ID NO: 29000 - protein, 209 aa, Homo sapiens
  Payload ID: 5651
  Gene Symbol: ERCC1
  Gene Name: excision repair cross-complementation group 1
  ENSP ID: ENSP00000468548
MDPGKDKEGVPQPSGPPARKKFVIPLDEDEVPPGVRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQK

SEQ ID NO: 29001 - protein, 706 aa, Homo sapiens
  Payload ID: 5652
  Gene Symbol: ERCC2
  Gene Name: excision repair cross-complementation group 2
  ENSP ID: ENSP00000375805
MRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHR

SEQ ID NO: 29002 - protein, 682 aa, Homo sapiens
  Payload ID: 5652
  Gene Symbol: ERCC2
  Gene Name: excision repair cross-complementation group 2
  ENSP ID: ENSP00000375808
MKLNVDGLLVYFPYDYIYPEQFSYMRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 29003 - protein, 760 aa, Homo sapiens
  Payload ID: 5652
  Gene Symbol: ERCC2
  Gene Name: excision repair cross-complementation group 2
  Uniprot ID: P18074
  ENSP ID: ENSP00000375809
MKLNVDGLLVYFPYDYIYPEQFSYMRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 29004 - protein, 405 aa, Homo sapiens
  Payload ID: 5652
  Gene Symbol: ERCC2
  Gene Name: excision repair cross-complementation group 2
  Uniprot ID: P18074
  ENSP ID: ENSP00000431229
MRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGQAQHCGSSRNQKRSHP

SEQ ID NO: 29005 - protein, 292 aa, Homo sapiens
  Payload ID: 5652
  Gene Symbol: ERCC2
  Gene Name: excision repair cross-complementation group 2
  ENSP ID: ENSP00000464887
MRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQ

SEQ ID NO: 29006 - protein, 127 aa, Homo sapiens
  Payload ID: 5652
  Gene Symbol: ERCC2
  Gene Name: excision repair cross-complementation group 2
  ENSP ID: ENSP00000465207
MKLNVDGLLVYFPYDYIYPEQFSYMRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPETTSASTP

SEQ ID NO: 29007 - protein, 202 aa, Homo sapiens
  Payload ID: 5652
  Gene Symbol: ERCC2
  Gene Name: excision repair cross-complementation group 2
  ENSP ID: ENSP00000465593
  MOD_RES (1)..(1): Any amino acid
XEASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPML

SEQ ID NO: 29008 - protein, 109 aa, Homo sapiens
  Payload ID: 5652
  Gene Symbol: ERCC2
  Gene Name: excision repair cross-complementation group 2
  ENSP ID: ENSP00000466998
MRELKRTLDAKAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYE

SEQ ID NO: 29009 - protein, 782 aa, Homo sapiens
  Payload ID: 5653
  Gene Symbol: ERCC3
  Gene Name: excision repair cross-complementation group 3
  Uniprot ID: P19447
  ENSP ID: ENSP00000285398
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 29010 - protein, 71 aa, Homo sapiens
  Payload ID: 5653
  Gene Symbol: ERCC3
  Gene Name: excision repair cross-complementation group 3
  ENSP ID: ENSP00000390888
MGKRDRADRGETLRGHAQPRLPLPALPPALPRSCSGPLRRPTLLALPRAPRWDRPLGGRDAGPGRSPANSA

SEQ ID NO: 29011 - protein, 188 aa, Homo sapiens
  Payload ID: 5653
  Gene Symbol: ERCC3
  Gene Name: excision repair cross-complementation group 3
  ENSP ID: ENSP00000408901
  MOD_RES (1)..(1): Any amino acid
XLCTVSYGKVKLVLKHNRYFVESCHPDVIQHLLQDPVIRECRLRNSEGEATELITETFTSKSAHLPLSQISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVI

SEQ ID NO: 29012 - protein, 71 aa, Homo sapiens; identical to SEQ ID NO: 29010
  Payload ID: 5653
  Gene Symbol: ERCC3
  Gene Name: excision repair cross-complementation group 3
  ENSP ID: ENSP00000415335

SEQ ID NO: 29013 - protein, 916 aa, Homo sapiens
  Payload ID: 5654
  Gene Symbol: ERCC4
  Gene Name: excision repair cross-complementation group 4
  Uniprot ID: Q92889
  ENSP ID: ENSP00000310520
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRVYFLIYGGSTEEQRYLTALRKEKEAFEKLIREKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAEVVSKGKGKK

SEQ ID NO: 29014 - protein, 372 aa, Homo sapiens
  Payload ID: 5654
  Gene Symbol: ERCC4
  Gene Name: excision repair cross-complementation group 4
  Uniprot ID: Q92889
  ENSP ID: ENSP00000459933
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEGILWG

SEQ ID NO: 29015 - protein, 35 aa, Homo sapiens
  Payload ID: 5654
  Gene Symbol: ERCC4
  Gene Name: excision repair cross-complementation group 4
  ENSP ID: ENSP00000461322
RVYFLIYGGSTEEQRYLTALRKEKEAFEKLIRSTV

SEQ ID NO: 29016 - protein, 75 aa, Homo sapiens
  Payload ID: 5654
  Gene Symbol: ERCC4
  Gene Name: excision repair cross-complementation group 4
  ENSP ID: ENSP00000461883
  MOD_RES (1)..(1): Any amino acid
XPSGILVYRAHRIIESCQEAFILRLFRQKNKRGFIKAFTDNAVAFDTGFCHVERVMRNLFVRKLYLWPRLLYWTF

SEQ ID NO: 29017 - protein, 1186 aa, Homo sapiens
  Payload ID: 5655
  Gene Symbol: ERCC5
  Gene Name: excision repair cross-complementation group 5
  Uniprot ID: P28715
  ENSP ID: ENSP00000347978
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKGKTQKRGITNTLEESSSLKRKRLSDSKGKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 29018 - protein, 419 aa, Homo sapiens
  Payload ID: 5655
  Gene Symbol: ERCC5
  Gene Name: excision repair cross-complementation group 5
  Uniprot ID: P28715
  ENSP ID: ENSP00000365121
MFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKGKTQKRGITNTLEESSSLKRKRLSDSKGKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 29019 - protein, 43 aa, Homo sapiens
  Payload ID: 5655
  Gene Symbol: ERCC5
  Gene Name: excision repair cross-complementation group 5
  ENSP ID: ENSP00000436083
MGVQGLWKLLECSGRQTILVASRNIDLIQDRCTSTPSSTSEIY

SEQ ID NO: 29020 - protein, 232 aa, Homo sapiens
  Payload ID: 5655
  Gene Symbol: ERCC5
  Gene Name: excision repair cross-complementation group 5
  Uniprot ID: P28715
  ENSP ID: ENSP00000442117
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEVYLPLLQP

SEQ ID NO: 29021 - protein, 1185 aa, Homo sapiens
  Payload ID: 5655
  Gene Symbol: ERCC5
  Gene Name: excision repair cross-complementation group 5
  ENSP ID: ENSP00000478667
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTRNTNCGLCTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKGKTQKRGITNTLEESSSLKRKRLSDSKGKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 29022 - protein, 1493 aa, Homo sapiens
  Payload ID: 5656
  Gene Symbol: ERCC6
  Gene Name: excision repair cross-complementation group 6
  Uniprot ID: Q03468
  ENSP ID: ENSP00000348089
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLRRWNKLRLQDKEKRLKLEDDSEESDAEFDEGFKVPGFLFKKLFKYQQTGVRWLWELHCQQAGGILGDEMGLGKTIQIIAFLAGLSYSKIRTRGSNYRFEGLGPTVIVCPTTVMHQWVKEFHTWWPPFRVAILHETGSYTHKKEKLIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 29023 - protein, 179 aa, Homo sapiens
  Payload ID: 5656
  Gene Symbol: ERCC6
  Gene Name: excision repair cross-complementation group 6
  ENSP ID: ENSP00000422827
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKY

SEQ ID NO: 29024 - protein, 77 aa, Homo sapiens
  Payload ID: 5656
  Gene Symbol: ERCC6
  Gene Name: excision repair cross-complementation group 6
  ENSP ID: ENSP00000485163
  MOD_RES (1)..(1): Any amino acid
XDSKEVYRILNGEMQEVLQSFTSIHLHESPLNFFRSFQVRGSRSHYPGKGMQTTLGIVNFLVVTLKRKKRNRFSPDL

SEQ ID NO: 29025 - protein, 863 aa, Homo sapiens
  Payload ID: 5656
  Gene Symbol: ERCC6
  Gene Name: excision repair cross-complementation group 6
  ENSP ID: ENSP00000485321
MQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 29026 - protein, 117 aa, Homo sapiens
  Payload ID: 5656
  Gene Symbol: ERCC6
  Gene Name: excision repair cross-complementation group 6
  ENSP ID: ENSP00000485423
MGLGKTIQIIAFLAGLSYSKIRTRGSNYRFEGLGPTVIVCPTTVMHQWVKEFHTWWPPFRVAILHETGSYTHKKEKLIRDVAHCHGILITSYSYIRLMQDDISRYDWHYVILDEGHK

SEQ ID NO: 29027 - protein, 76 aa, Homo sapiens
  Payload ID: 5656
  Gene Symbol: ERCC6
  Gene Name: excision repair cross-complementation group 6
  ENSP ID: ENSP00000485650
MGLGKTIQIIAFLAGLSYSKIRTRGSNYRFEGLGPTVIVCPTTVMHQWVKEFHTWWPPFRVAILHETGSYTHKKVQ

SEQ ID NO: 29028 - protein, 1250 aa, Homo sapiens
  Payload ID: 5657
  Gene Symbol: ERCC6L
  Gene Name: excision repair cross-complementation group 6-like
  Uniprot ID: Q2NKX8
  ENSP ID: ENSP00000334675
MEASRRFPEAEALSPEQAAHYLRYVKEAKEATKNGDLEEAFKLFNLAKDIFPNEKVLSRIQKIQEALEELAEQGDDEFTDVCNSGLLLYRELHNQLFEHQKEGIAFLYSLYRDGRKGGILADDMGLGKTVQIIAFLSGMFDASLVNHVLLIMPTNLINTWVKEFIKWTPGMRVKTFHGPSKDERTRNLNRIQQRNGVIITTYQMLINNWQQLSSFRGQEFVWDYVILDEAHKIKTSSTKSAICARAIPASNRLLLTGTPIQNNLQELWSLFDFACQGSLLGTLKTFKMEYENPITRAREKDATPGEKALGFKISENLMAIIKPYFLRRTKEDVQKKKSSNPEARLNEKNPDVDAICEMPSLSRKNDLIIWIRLVPLQEEIYRKFVSLDHIKELLMETRSPLAELGVLKKLCDHPRLLSARACCLLNLGTFSAQDGNEGEDSPDVDHIDQVTDDTLMEESGKMIFLMDLLKRLRDEGHQTLVFSQSRQILNIIERLLKNRHFKTLRIDGTVTHLLEREKRINLFQQNKDYSVFLLTTQVGGVGLTLTAATRVVIFDPSWNPATDAQAVDRVYRIGQKENVVVYRLITCGTVEEKIYRRQVFKDSLIRQTTGEKKNPFRYFSKQELRELFTIEDLQNSVTQLQLQSLHAAQRKSDIKLDEHIAYLQSLGIAGISDHDLMYTCDLSVKEELDVVEESHYIQQRVQKAQFLVEFESQNKEFLMEQQRTRNEGAWLREPVFPSSTKKKCPKLNKPQPQPSPLLSTHHTQEEDISSKMASVVIDDLPKEGEKQDLSSIKVNVTTLQDGKGTGSADSIATLPKGFGSVEELCTNSSLGMEKSFATKNEAVQKETLQEGPKQEALQEDPLESFNYVLSKSTKADIGPNLDQLKDDEILRHCNPWPIISITNESQNAESNVSIIEIADDLSASHSALQDAQASEAKLEEEPSASSPQYACDFNLFLEDSADNRQNFSSQSLEHVEKENSLCGSAPNSRAGFVHSKTCLSWEFSEKDDEPEEVVVKAKIRSKARRIVSDGEDEDDSFKDTSSINPFNTSLFQFSSVKQFDASTPKNDISPPGRFFSSQIPSSVNKSMNSRRSLASRRSLINMVLDHVEDMEERLDDSSEAKGPEDYPEEGVEESSGEASKYTEEDPSGETLSSENKSSWLMTSKPSALAQETSLGAPEPLSGEQLVGSPQDKAAEATNDYETLVKRGKELKECGKIQEALNCLVKALDIKSADPEVMLLTLSLYKQLNNN

SEQ ID NO: 29029 - protein, 1127 aa, Homo sapiens
  Payload ID: 5657
  Gene Symbol: ERCC6L
  Gene Name: excision repair cross-complementation group 6-like
  ENSP ID: ENSP00000362761
MGLGKTVQIIAFLSGMFDASLVNHVLLIMPTNLINTWVKEFIKWTPGMRVKTFHGPSKDERTRNLNRIQQRNGVIITTYQMLINNWQQLSSFRGQEFVWDYVILDEAHKIKTSSTKSAICARAIPASNRLLLTGTPIQNNLQELWSLFDFACQGSLLGTLKTFKMEYENPITRAREKDATPGEKALGFKISENLMAIIKPYFLRRTKEDVQKKKSSNPEARLNEKNPDVDAICEMPSLSRKNDLIIWIRLVPLQEEIYRKFVSLDHIKELLMETRSPLAELGVLKKLCDHPRLLSARACCLLNLGTFSAQDGNEGEDSPDVDHIDQVTDDTLMEESGKMIFLMDLLKRLRDEGHQTLVFSQSRQILNIIERLLKNRHFKTLRIDGTVTHLLEREKRINLFQQNKDYSVFLLTTQVGGVGLTLTAATRVVIFDPSWNPATDAQAVDRVYRIGQKENVVVYRLITCGTVEEKIYRRQVFKDSLIRQTTGEKKNPFRYFSKQELRELFTIEDLQNSVTQLQLQSLHAAQRKSDIKLDEHIAYLQSLGIAGISDHDLMYTCDLSVKEELDVVEESHYIQQRVQKAQFLVEFESQNKEFLMEQQRTRNEGAWLREPVFPSSTKKKCPKLNKPQPQPSPLLSTHHTQEEDISSKMASVVIDDLPKEGEKQDLSSIKVNVTTLQDGKGTGSADSIATLPKGFGSVEELCTNSSLGMEKSFATKNEAVQKETLQEGPKQEALQEDPLESFNYVLSKSTKADIGPNLDQLKDDEILRHCNPWPIISITNESQNAESNVSIIEIADDLSASHSALQDAQASEAKLEEEPSASSPQYACDFNLFLEDSADNRQNFSSQSLEHVEKENSLCGSAPNSRAGFVHSKTCLSWEFSEKDDEPEEVVVKAKIRSKARRIVSDGEDEDDSFKDTSSINPFNTSLFQFSSVKQFDASTPKNDISPPGRFFSSQIPSSVNKSMNSRRSLASRRSLINMVLDHVEDMEERLDDSSEAKGPEDYPEEGVEESSGEASKYTEEDPSGETLSSENKSSWLMTSKPSALAQETSLGAPEPLSGEQLVGSPQDKAAEATNDYETLVKRGKELKECGKIQEALNCLVKALDIKSADPEVMLLTLSLYKQLNNN

SEQ ID NO: 29030 - protein, 712 aa, Homo sapiens
  Payload ID: 5658
  Gene Symbol: ERCC6L2
  Gene Name: excision repair cross-complementation group 6-like 2
  Uniprot ID: Q5T890
  ENSP ID: ENSP00000288985
MQPGSAPPPGRMDPSAPQPRAETSGKDIWHPGERCLAPSPDNGKLCEASIKSITVDENGKSFAVVLYADFQERKIPLKQLQEVKFVKDCPRNLIFDDEDLEKPYFPNRKFPSSSVAFKLSDNGDSIPYTINRYLRDYQREGTRFLYGHYIHGGGCILGDDMGLGKTVQVISFLAAVLHKKGTREDIENNMPEFLLRSMKKEPLSSTAKKMFLIVAPLSVLYNWKDELDTWGYFRVTVLHGNRKDNELIRVKQRKCEIALTTYETLRLCLDELNSLEWSAVIVDEAHRIKNPKARVTEVMKALKCNVRIGLTGTILQNNMKELWCVMDWAVPGLLGSGTYFKKQFSDPVEHGQRHTATKRELATGRKAMQRLAKKMSGWFLRRTKTLIKDQLPKKEDRMVYCSLTDFQKAVYQTVLETEDVTLILQSSEPCTCRSGQKRRNCCYKTNSHGETVKTLYLSYLTVLQKVANHVALLQAASTSKQQETLIKRICDQVFSRFPDFVQKSKDAAFETLSDPKYSGKMKVLQQLLNHCRKNRDKVLLFSFSTKLLDVLQQYCMASGLDYRRLDGSTKSEERLKIVKEFNSTQDVNICLVSTMAGGLGLNFVGANVVVLFDPTWNPANDLQAIDRAYRIGQCRDVKVLRLISLGTVEEIMYLRQIYKQQLHCVVVGSENAKRYFEAVQGSKEHQGELFGIHNLFKFRSQGSCLTKDILEV

SEQ ID NO: 29031 - protein, 522 aa, Homo sapiens
  Payload ID: 5658
  Gene Symbol: ERCC6L2
  Gene Name: excision repair cross-complementation group 6-like 2
  ENSP ID: ENSP00000320939
  MOD_RES (1)..(1): Any amino acid
XNEDHNSQFIDDYSSSDESLSVSHFSFSKQSHRPRTIRDRTSFSSKLPSHNKKNSTFIPRKPMKCSNEKVVNQEQSYESMDKFLDGVQEVAYIHSNQNVIGSSKAENHMSRWAAHDVFELKQFSQLPANIAVCSSKTYKEKVDADTLPHTKKGQQPSEGSISLPLYISNPVNQKKKKVYHTNQTTFIIGETPKGIRRKQFEEMASYFNSSSVNEFAKHITNATSEERQKMLRDFYASQYPEVKEFFVDSVSQFNNSSFEKGEQRTRKKSDKRESLIKPRLSDSETLSFKDSTNKISQVCSLKTYKRKSVKFQNHISYREEVFFNDAETKKSPVSSTQEIDSGKNSQASEDTVTSRSLNSESETRERRLENTMKDQQDLTRTGISRKEPLLKLENKKIENPVLENTSVISLLGDTSILDDLFKSHGNSPTQLPKKVLSGPMEKAKQRPKDFWDILNEQNDESLSKLTDLAVIETLCEKAPLAAPFKRREEPATSLWKSNEKFLWKKFSPSDTDENATNTQSTT

SEQ ID NO: 29032 - protein, 182 aa, Homo sapiens
  Payload ID: 5658
  Gene Symbol: ERCC6L2
  Gene Name: excision repair cross-complementation group 6-like 2
  ENSP ID: ENSP00000384215
  MOD_RES (1)..(1): Any amino acid
XGIHNLFKFRSQGSCLTKDILEREGQVEAGIMTATTWLKEGPPAHKLEMPRQPDCQECRGTEQAAEPLAKEACDLCSDFSDEEPVGATGIKTAKNKAPDSSKASSSPGQLTLLQCGFSKLLETKCKAVEDSDGNTASDDESSDEQPTCLSTEAKDAGCEKNQDSLGTSKHQKLDNILNPKEK

SEQ ID NO: 29033 - protein, 82 aa, Homo sapiens
  Payload ID: 5658
  Gene Symbol: ERCC6L2
  Gene Name: excision repair cross-complementation group 6-like 2
  ENSP ID: ENSP00000395345
DPKYSGKMKVLQQLLNHCRKNRDKVLLFSFSTKLLDVLQQYCMASGLDYRRLDGSTKSEERLKIVKEFNSTQDVNICLVSTM

SEQ ID NO: 29034 - protein, 365 aa, Homo sapiens
  Payload ID: 5658
  Gene Symbol: ERCC6L2
  Gene Name: excision repair cross-complementation group 6-like 2
  ENSP ID: ENSP00000409751
MKELWCVMDWAVPGLLGSGTYFKKQFSDPVEHGQRHTATKRELATGRKAMQRLAKKMSGWFLRRTKTLIKDQLPKKEDRMVYCSLTDFQKAVYQTVLETEDVTLILQSSEPCTCRSGQKRRNCCYKTNSHGETVKTLYLSYLTVLQKVANHVALLQAASTSKQQETLIKRICDQVFSRFPDFVQKSKDAAFETLSDPKYSGKMKVLQQLLNHCRKNRDKVLLFSFSTKLLDVLQQYCMASGLDYRRLDGSTKSEERLKIVKEFNSTQDVNICLVSTMAGGLGLNFVGANVVVLFDPTWNPANDLQAIDRTQTHCRRERDAEPLSSAPGLQNGSENAVPYPWWCCVTGASISCWRCEICRIQDVLE

SEQ ID NO: 29035 - protein, 54 aa, Homo sapiens
  Payload ID: 5658
  Gene Symbol: ERCC6L2
  Gene Name: excision repair cross-complementation group 6-like 2
  ENSP ID: ENSP00000473877
  MOD_RES (1)..(1): Any amino acid
XTSKQQETLIKRICDQVFSRFPDFVQKSKDAAFETLSDPKYSGKMKVSSSKVYP

SEQ ID NO: 29036 - protein, 396 aa, Homo sapiens
  Payload ID: 5659
  Gene Symbol: ERCC8
  Gene Name: excision repair cross-complementation group 8
  Uniprot ID: Q13216
  ENSP ID: ENSP00000265038
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 29037 - protein, 57 aa, Homo sapiens
  Payload ID: 5659
  Gene Symbol: ERCC8
  Gene Name: excision repair cross-complementation group 8
  ENSP ID: ENSP00000370510
MLGFLSARQTGLEDPLRLRRAESTRRVLGLELNKDRDVERIHGGGINTLDIEPVEGR

SEQ ID NO: 29038 - protein, 134 aa, Homo sapiens
  Payload ID: 5659
  Gene Symbol: ERCC8
  Gene Name: excision repair cross-complementation group 8
  ENSP ID: ENSP00000408344
MLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAV

SEQ ID NO: 29039 - protein, 894 aa, Homo sapiens
  Payload ID: 5660
  Gene Symbol: EXOC1
  Gene Name: exocyst complex component 1
  Uniprot ID: Q9NV70
  ENSP ID: ENSP00000326514
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQGHDQSSTLAQHSVELTLPNHHPFHRDLLRYAKLMEWLKSTDYGKYEGLTKNYMDYLSRLYEREIKDFFEVAKIKMTGTTKESKKFATLPRKESAVKQETESLHGSSGKLTGSTSSLNKLSVQSSGNRRSQSSSLLDMGNMSASDLDVADRTKFDKIFEQVLSELEPLCLAEQDFISKFFKLQQHQSMPGTMAEAEDLDGGTLSRQHNCGTPLPVSSEKDMIRQMMIKIFRCIEPELNNLIALGDKIDSFNSLYMLVKMSHHVWTAQNVDPASFLSTTLGNVLVTVKRNFDKCISNQIRQMEEVKISKKSKVGILPFVAEFEEFAGLAESIFKNAERRGDLDKAYTKLIRGVFVNVEKVANESQKTPRDVVMMENFHHIFATLSRLKISCLEAEKKEAKQKYTDHLQSYVIYSLGQPLEKLNHFFEGVEARVAQGIREEEVSYQLAFNKQELRKVIKEYPGKEVKKGLDNLYKKVDKHLCEEENLLQVVWHSMQDEFIRQYKHFEGLIARCYPGSGVTMEFTIQDILDYCSSIAQSH

SEQ ID NO: 29040 - protein, 879 aa, Homo sapiens
  Payload ID: 5660
  Gene Symbol: EXOC1
  Gene Name: exocyst complex component 1
  Uniprot ID: Q9NV70
  ENSP ID: ENSP00000334431
MTAIKHALQRDIFTPNDERLLSIVNVCKAGKKKKNCFLCATVTTERPVQVKVVKVKKSDKGDFYKRQIAWALRDLAVVDAKDAIKENPEFDLHFEKIYKWVASSTAEKNAFISCIWKLNQRYLRKKIDFVNVSSQLLEESVPSGENQSVTGGDEEVVDEYQELNAREEQDIEIMMEGCEYAISNAEAFAEKLSRELQVLDGANIQSIMASEKQVNILMKLLDEALKEVDQIELKLSSYEEMLQSVKEQMDQISESNHLIHLSNTNNVKLLSEIEFLVNHMDLAKGHIKALQEGDLASSRGIEACTNAADALLQCMNVALRPGHDLLLAVKQQQQRFSDLRELFARRLASHLNNVFVQQGHDQSSTLAQHSVELTLPNHHPFHRDLLRYAKLMEWLKSTDYGKYEGLTKNYMDYLSRLYEREIKDFFEVAKIKMTGTTKESKKFGLHGSSGKLTGSTSSLNKLSVQSSGNRRSQSSSLLDMGNMSASDLDVADRTKFDKIFEQVLSELEPLCLAEQDFISKFFKLQQHQSMPGTMAEAEDLDGGTLSRQHNCGTPLPVSSEKDMIRQMMIKIFRCIEPELNNLIALGDKIDSFNSLYMLVKMSHHVWTAQNVDPASFLSTTLGNVLVTVKRNFDKCISNQIRQMEEVKISKKSKVGILPFVAEFEEFAGLAESIFKNAERRGDLDKAYTKLIRGVFVNVEKVANESQKTPRDVVMMENFHHIFATLSRLKISCLEAEKKEAKQKYTDHLQSYVIYSLGQPLEKLNHFFEGVEARVAQGIREEEVSYQLAFNKQELRKVIKEYPGKEVKKGLDNLYKKVDKHLCEEENLLQVVWHSMQDEFIRQYKHFEGLIARCYPGSGVTMEFTIQDILDYCSSIAQSH

SEQ ID NO: 29041 - protein, 894 aa, Homo sapiens; identical to SEQ ID NO: 29039
  Payload ID: 5660
  Gene Symbol: EXOC1
  Gene Name: exocyst complex component 1
  Uniprot ID: Q9NV70
  ENSP ID: ENSP00000370695

SEQ ID NO: 29042 - protein, 924 aa, Homo sapiens
  Payload ID: 5661
  Gene Symbol: EXOC2
  Gene Name: exocyst complex component 2
  Uniprot ID: Q96KP1
  ENSP ID: ENSP00000230449
MSRSRQPPLVTGISPNEGIPWTKVTIRGENLGTGPTDLIGLTICGHNCLLTAEWMSASKIVCRVGQAKNDKGDIIVTTKSGGRGTSTVSFKLLKPEKIGILDQSAVWVDEMNYYDMRTDRNKGIPPLSLRPANPLGIEIEKSKFSQKDLEMLFHGMSADFTSENFSAAWYLIENHSNTSFEQLKMAVTNLKRQANKKSEGSLAYVKGGLSTFFEAQDALSAIHQKLEADGTEKVEGSMTQKLENVLNRASNTADTLFQEVLGRKDKADSTRNALNVLQRFKFLFNLPLNIERNIQKGDYDVVINDYEKAKSLFGKTEVQVFKKYYAEVETRIEALRELLLDKLLETPSTLHDQKRYIRYLSDLHASGDPAWQCIGAQHKWILQLMHSCKEGYVKDLKGNPGLHSPMLDLDNDTRPSVLGHLSQTASLKRGSSFQSGRDDTWRYKTPHRVAFVEKLTKLVLSQLPNFWKLWISYVNGSLFSETAEKSGQIERSKNVRQRQNDFKKMIQEVMHSLVKLTRGALLPLSIRDGEAKQYGGWEVKCELSGQWLAHAIQTVRLTHESLTALEIPNDLLQTIQDLILDLRVRCVMATLQHTAEEIKRLAEKEDWIVDNEGLTSLPCQFEQCIVCSLQSLKGVLECKPGEASVFQQPKTQEEVCQLSINIMQVFIYCLEQLSTKPDADIDTTHLSVDVSSPDLFGSIHEDFSLTSEQRLLIVLSNCCYLERHTFLNIAEHFEKHNFQGIEKITQVSMASLKELDQRLFENYIELKADPIVGSLEPGIYAGYFDWKDCLPPTGVRNYLKEALVNIIAVHAEVFTISKELVPRVLSKVIEAVSEELSRLMQCVSSFSKNGALQARLEICALRDTVAVYLTPESKSSFKQALEALPQLSSGADKKLLEELLNKFKSSMHLQLTCFQAASSTMMKT

SEQ ID NO: 29043 - protein, 140 aa, Homo sapiens
  Payload ID: 5661
  Gene Symbol: EXOC2
  Gene Name: exocyst complex component 2
  ENSP ID: ENSP00000406400
MSRSRQPPLVTGISPNEGIPWTKVTIRGENLGTGPTDLIGLTICGHNCLLTAEWMSASKIVCRVGQAKNDKGDIIVTTKSGGRGTSTVSFKLLKPEKIGILDQSAVWVDEMNYYDMRTDRNKGIPPLSLRPANPLGIEIE

SEQ ID NO: 29044 - protein, 745 aa, Homo sapiens
  Payload ID: 5662
  Gene Symbol: EXOC3
  Gene Name: exocyst complex component 3
  Uniprot ID: O60645
  ENSP ID: ENSP00000323377
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 29045 - protein, 68 aa, Homo sapiens
  Payload ID: 5662
  Gene Symbol: EXOC3
  Gene Name: exocyst complex component 3
  ENSP ID: ENSP00000422596
MKETDREAVATAVQRVAGMLQRPDQLDKVEQYRRREARKKASVEARLKAAIQSQLDGVRTGLSQLHNA

SEQ ID NO: 29046 - protein, 473 aa, Homo sapiens
  Payload ID: 5662
  Gene Symbol: EXOC3
  Gene Name: exocyst complex component 3
  ENSP ID: ENSP00000423435
  MOD_RES (1)..(1): Any amino acid
XLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKVRRWDLVPSSP

SEQ ID NO: 29047 - protein, 462 aa, Homo sapiens
  Payload ID: 5662
  Gene Symbol: EXOC3
  Gene Name: exocyst complex component 3
  ENSP ID: ENSP00000424404
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTRYKDEAQLYKEEHLRNRQHPHCYVQYMIAIINNCQTFKESIVSLKRKYLKNEVEEGVSPSQPSMDGILDAIAKEGCSGLLEEVFLDLEVGLALSSCRFLGRSPVLPHCPLGHRL

SEQ ID NO: 29048 - protein, 745 aa, Homo sapiens; identical to SEQ ID NO: 29044
  Payload ID: 5662
  Gene Symbol: EXOC3
  Gene Name: exocyst complex component 3
  Uniprot ID: O60645
  ENSP ID: ENSP00000425587

SEQ ID NO: 29049 - protein, 746 aa, Homo sapiens
  Payload ID: 5663
  Gene Symbol: EXOC3L1
  Gene Name: exocyst complex component 3-like 1
  Uniprot ID: Q86VI1
  ENSP ID: ENSP00000325674
MDSAAKDEMQPALSPGPEWPEQERAEQLARGAALKWASGIFYRPEQLARLGQYRSREVQRTCSLESRLKSVMQSYLEGVQTGVWQLAQAIEVVQGTREALSQARGLLQGMSQALQTLEPLRERVAQHKQLQALSHLLPRLRAVPAAVSHTQTLIDGQQFLEAYVSLRELEQLREDTWAPLGGLELPVFQGLDLLFEALGQAVEAAAGAAGKLAREDPALLVAAVRVAEVETGRTTPLGQVPRDWRQRCLRALQEGLEQAHFGSPLLPAPGALPGWLEALRVALPVELATAEALVAPCCPPQYNVVQLWAHTLHSGLRRSLQNLLAGPELEAADAFALLHWALHVYLGQEMMGSLELGPEADVSQLEPLLTLENIEQLEATFVANIQASVSQWLQNALDGEVAEWGREHGPNTDPSGSYYSPMPAIVLQILEENIRVASLVSESLQQRVHGMALSELGTFLRSFSDALIRFSRDHFRGKSMAPHYVPYLLAALNHKSALSSSVSVLQLDGAPSGALAPVEAALDELQRRIYRLVLEALQAELQPLFADLPSRQWLSSPELLQSVCERTGRFCRDFWRVRNPTVQLLLAEAERAVVLQYLSALMQGRLVCRGADERTQAAERLRHDAAQLQQLFLSLGLEENAHCAPVLLALRELLNLRDPALLGLEVAGLRQQFPDVSEDHVSALLGLRGDLSREQHLAALSSLQAALPPSPRASRRVLFSLVPAPALAPASCLPSGSCARALLLAE

SEQ ID NO: 29050 - protein, 679 aa, Homo sapiens
  Payload ID: 5663
  Gene Symbol: EXOC3L1
  Gene Name: exocyst complex component 3-like 1
  ENSP ID: ENSP00000439910
MDSAAKDEMQPALSPGPEWPEQERAEQLARGAALKWASGIFYRPEQLARLGQYRSREVQRTCSLESRLKSVMQSYLEGVQTVPAAVSHTQTLIDGQQFLEAYVSLRELEQLREDTWAPLGGLELPVFQGLDLLFEALGQAVEAAAGAAGKLAREDPALLVAAVRVAEVETGRTTPLGQVPRDWRQRCLRALQEGLEQAHFGSPLLPAPGALPGWLEALRVALPVELATAEALVAPCCPPQYNVVQLWAHTLHSGLRRSLQNLLAGPELEAADAFALLHWALHVYLGQEMMGSLELGPEADVSQLEPLLTLENIEQLEATFVANIQILEENIRVASLVSESLQQRVHGMALSELGTFLRSFSDALIRFSRDHFRGKSMAPHYVPYLLAALNHKSALSSSVSVLQLDGAPSGALAPVEAALDELQRRIYRLVLEALQAELQPLFADLPSRQWLSSPELLQSVCERTGRFCRDFWRVRNPTVQLLLAEAERAVVLQYLSALMQGRLVCRGADERTQAAERLRHDAAQLQQLFLSLVRASWAGRRARVSVAGWERGLARDPTPTCSGPGGERALRAGAARPEGAAKPPRPRAAGPGGGWPAATISRRERGPRLRPLGPARGLVPGAAPGRAQLPAGCAAAVAPREPPRPLQPSARARARAGLLPALGVLRPSPAARRINHGCR

SEQ ID NO: 29051 - protein, 684 aa, Homo sapiens
  Payload ID: 5663
  Gene Symbol: EXOC3L1
  Gene Name: exocyst complex component 3-like 1
  ENSP ID: ENSP00000455223
MDSAAKDEMQPALSPGSSFPGPEWPEQERAEQLARGAALKWASGIFYRPEQLARLGQYRSREVQRTCSLESRLKSVMQSYLEGVQTVPAAVSHTQTLIDGQQFLEAYVSLRELEQLREDTWAPLGGLELPVFQGLDLLFEALGQAVEAAAGAAGKLAREDPALLVAAVRVAEVETGRTTPLGQVPRDWRQRCLRALQEGLEQAHFGSPLLPAPGALPGWLEALRVALPVELATAEALVAPCCPPQYNVVQLWAHTLHSGLRRSLQNLLAGPELEAADAFALLHWALHVYLGQEMMGSLELGPEADVSQLEPLLTLENIEQLEATFVANIQILEENIRVASLVSESLQQRVHGMALSELGTFLRSFSDALIRFSRDHFRGKSMAPHYVPYLLAALNHKSALSSSVSVLQLDGAPSGALAPVEAALDELQRRIYRLVLEALQAELQPLFADLPSRQWLSSPELLQSVCERTGRFCRDFWRVRNPTVQLLLAEAERAVVLQYLSALMQGRLVCRGADERTQAAERLRHDAAQLQQLFLSLVRASWAGRRARVSVAGWERGLARDPTPTCSGPGGERALRAGAARPEGAAKPPRPRAAGPGGGWPAATISRRERGPRLRPLGPARGLVPGAAPGRAQLPAGCAAAVAPREPPRPLQPSARARARAGLLPALGVLRPSPAARRINHGCR

SEQ ID NO: 29052 - protein, 80 aa, Homo sapiens
  Payload ID: 5663
  Gene Symbol: EXOC3L1
  Gene Name: exocyst complex component 3-like 1
  ENSP ID: ENSP00000456435
MDSAAKDEMQPALSPGPEWPEQERAEQLARGAALKWASGIFYRPEQLARLGQYRSREVQRTCSLESRLKAGNDGEPGVGA

SEQ ID NO: 29053 - protein, 181 aa, Homo sapiens
  Payload ID: 5663
  Gene Symbol: EXOC3L1
  Gene Name: exocyst complex component 3-like 1
  ENSP ID: ENSP00000457182
MDSAAKDEMQPALSPGPEWPEQERAEQLARGAALKWASGIFYRPEQLARLGQYRSREVQRTCSLESRLKSVMQSYLEGVQTGVWQLAQAIEVVQGTREALSQARGLLQGMSQALQTLEPLRERVAQHKQLQALSHLLPRLRAVPAAVSHTQTLIDGQQFLEAYVSLRELEQLREDTWAPLG

SEQ ID NO: 29054 - protein, 409 aa, Homo sapiens
  Payload ID: 5664
  Gene Symbol: EXOC3L2
  Gene Name: exocyst complex component 3-like 2
  Uniprot ID: Q2M3D2
  ENSP ID: ENSP00000252482
MAALENGELGPLLSPGTLRGLEDECVTDVKAQTRAALLRVLQEDEEHWGSLEDQPSSLAQDVCELLEEHTERAPRISQEFGERMAHCCLGGLAEFLQSFQQRVERFHENPAVREMLPDTYISKTIALVNCGPPLRALAERLARVGPPESEPAREASASALDHVTRLCHRVVANLLFQELQPHFNKLMRRKWLSSPEALDGIVGTLGAQALALRRMQDEPYQALVAELHRRALVEYVRPLLRGRLRCSSARTRSRVAGRLREDAAQLQRLFRRLESQASWLDAVVPHLAEVMQLEDTPSIQVEVGVLVRDYPDIRQKHVAALLDIRGLRNTAARQEILAVARDLELSEEGALSPPRDRAFFADIPVPRPSFCLSLPLFLGRLPLSRLARPSLACLPRPRPPSLARPRAQR

SEQ ID NO: 29055 - protein, 409 aa, Homo sapiens; identical to SEQ ID NO: 29054
  Payload ID: 5664
  Gene Symbol: EXOC3L2
  Gene Name: exocyst complex component 3-like 2
  Uniprot ID: Q2M3D2
  ENSP ID: ENSP00000400713

SEQ ID NO: 29056 - protein, 722 aa, Homo sapiens
  Payload ID: 5665
  Gene Symbol: EXOC3L4
  Gene Name: exocyst complex component 3-like 4
  Uniprot ID: Q17RC7
  ENSP ID: ENSP00000369409
MPSPQTDTPGPELQSPKEAEEPQTPAQGSRRTSSRKEPNAHRKDGTRLGLGSLRQAFSRASQRALTQVSKEDTGLFRRSSCSLFRSFRQALNDGPATGHSQATPEVPSGVMNGVSQQASTGAASEELKPEAEGKSVADLITERQLLAAFEQLLRLETLLVAEKASRTFEQDPTAFARRAMDVCLLYDGLAAEIGAIVRETLDSDGVDAAALAELARVVSAEEEAHPSPPDDGDFLRTPRRWRQHWEEAVRRSAQERVRRPGAGWAFGEAEGASGLAQLLAELGGLVRRDLQKVRQEVQPAYAAAGFPAWEVYLRAFHSAVAQRLQELARDARGCEQLYILLDWAANVYGSPDFLGAPGLALPAEPLPPLLAPDVWARLESDYTSFLEAKIASCFDSILQLEQSHWAAAEVPEVLQGLYQAPLSMDVHMLVAEHVKAAGAISAELEATTLRICTRALGLFVPRFEKAFLASEAVSEPHLGAYINACEELRTSLLSRFPGTQEELEKPLVTATCSFQKHLLQGLQRELQPLFRVVCTRDWLTQDWLHPLMDKVVTFAGHLQRVARPRAQETLQEVHRFVVREYLARALRPRERFRGMERMHGSQKMSLDAQAISDTFQGLGSEATWLDQAIQCVAEILGETYKDDIQRHLETLIRSYPDIRRDHILAILALRRLGRQRNQHLLQHTQDLLRAAAGAAGAEAPRGRVLFEEIKVPSAMAVLITCV

SEQ ID NO: 29057 - protein, 212 aa, Homo sapiens
  Payload ID: 5665
  Gene Symbol: EXOC3L4
  Gene Name: exocyst complex component 3-like 4
  ENSP ID: ENSP00000454036
  MOD_RES (1)..(1): Any amino acid
XQRVARPRAQETLQEVHRFVVREYLARALRPRERFRGMERMHGSQKMSLDAQAISDTFQGLGSEATWLDQAIQCVAEILGETYKDDIQRHLETLIRSYPDIRRDHILAILALRRLGRQRNQHLLQHTQDLLRAAAGAAGAEAPRGRVLFEEIKPSAAVRPEGAAVQEAFQASLRGVFWGRRALNAAYRAGGGLPPDCPASPSSLKVKSRVFI

SEQ ID NO: 29058 - protein, 153 aa, Homo sapiens
  Payload ID: 5665
  Gene Symbol: EXOC3L4
  Gene Name: exocyst complex component 3-like 4
  ENSP ID: ENSP00000454163
EPNAHRKDGTRLGLGSLRQAFSRASQRALTQVSKEDTGLFRRSSCSLFRSFRQALNDGPATGHSQATPEVPSGVMNGVSQQASTGAASEELKPEAVLTSWAPRGWRCPPSRCLRSWRRTCGPDWRATTPASWRPRSQAASTASCSWSRVTGRP

SEQ ID NO: 29059 - protein, 15 aa, Homo sapiens
  Payload ID: 5665
  Gene Symbol: EXOC3L4
  Gene Name: exocyst complex component 3-like 4
  ENSP ID: ENSP00000454174
  MOD_RES (1)..(1): Any amino acid
XGLYQAPLSMDVHMV

SEQ ID NO: 29060 - protein, 974 aa, Homo sapiens [sequence omitted]

SEQ ID NO: 29061 - protein, 473 aa, Homo sapiens
  Payload ID: 5666
  Gene Symbol: EXOC4
  Gene Name: exocyst complex component 4
  Uniprot ID: Q96A65
  ENSP ID: ENSP00000376868
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQG

SEQ ID NO: 29062 - protein, 643 aa, Homo sapiens
  Payload ID: 5667
  Gene Symbol: EXOC5
  Gene Name: exocyst complex component 5
  ENSP ID: ENSP00000342100
MATTAELFEEPFVADEYIERLVWRTPGGGSRGGPEAFDPKRLLEEFVNHIQELQIMDERIQRKVEKLEQQCQKEAKEFAKKVQELQKSNQIKEAADIIQKLHLIAQELPFDRFSEVKSKIASKYHDLECQLIQEFTSAQRRGEISRMREVAAVLLHFKGYSHCVDVYIKQCQEGAYLRNDIFEDAGILCQRVNKQVGDIFSNPETVLAKLIQNVFEIKLQSFVKEQLEECRKSDAEQYLKNLYDLYTRTTNLSSKLMEFNLGTDKQTFLSKLIKSIFISYLENYIEVETGYLKSRSAMILQRYYDSKNHQKRSIGTGGIQDLKERIRQRTNLPLGPSIDTHGETFLSQEVVVNLLQETKQAFERCHRLSDPSDLPRNAFRIFTILVEFLCIEHIDYALETGLAGIPSSDSRNANLYFLDVVQQANTIFHLFDKQFNDHLMPLISSSPKLSECLQKKKEIIEQMEMKLDTGIDRTLNCMIGQMKHILAAEQKKTDFKPEDENNVLIQYTNACVKVCAYVRKQVEKIKNSMDGKNVDTVLMELGVRFHRLIYEHLQQYSYSCMGGMLAICDVAEYRKCAKDFKIPMVLHLFDTLHALCNLLVVAPDNLKQVCSGEQLANLDKNILHSFVQLRADYRSARLARHFS

SEQ ID NO: 29063 - protein, 711 aa, Homo sapiens [sequence omitted]

SEQ ID NO: 29064 - protein, 44 aa, Homo sapiens
  Payload ID: 5667
  Gene Symbol: EXOC5
  Gene Name: exocyst complex component 5
  ENSP ID: ENSP00000451082
MATTAELFEEPFVADEYIERLVWRTPGGGSRGGPEAFDPKRNSR

SEQ ID NO: 29065 - protein, 62 aa, Homo sapiens
  Payload ID: 5667
  Gene Symbol: EXOC5
  Gene Name: exocyst complex component 5
  ENSP ID: ENSP00000452084
MDERIQRKVEKLEQQCQKEAKEFAKKVQELQKSNQVAFQHFQELDEHISYVATKVCHLGDQL

SEQ ID NO: 29066 - protein, 708 aa, Homo sapiens
  Payload ID: 5667
  Gene Symbol: EXOC5
  Gene Name: exocyst complex component 5
  Uniprot ID: O00471
  ENSP ID: ENSP00000484855
MATTAELFEEPFVADEYIERLVWRTPGGGSRGGPEAFDPKRLLEEFVNHIQELQIMDERIQRKVEKLEQQCQKEAKEFAKKVQELQKSNQVAFQHFQELDEHISYVATKVCHLGDQLEGVNTPRQRAVEAQKLMKYFNEFLDGELKSDVFTNSEKIKEAADIIQKLHLIAQELPFDRFSEVKSKIASKYHDLECQLIQEFTSAQRRGEISRMREVAAVLLHFKGYSHCVDVYIKQCQEGAYLRNDIFEDAGILCQRVNKQVGDIFSNPETVLAKLIQNVFEIKLQSFVKEQLEECRKSDAEQYLKNLYDLYTRTTNLSSKLMEFNLGTDKQTFLSKLIKSIFISYLENYIEVETGYLKSRSAMILQRYYDSKNHQKRSIGTGGIQDLKERIRQRTNLPLGPSIDTHGETFLSQEVVVNLLQETKQAFERCHRLSDPSDLPRNAFRIFTILVEFLCIEHIDYALETGLAGIPSSDSRNANLYFLDVVQQANTIFHLFDKQFNDHLMPLISSSPKLSECLQKKKEIIEQMEMKLDTGIDRTLNCMIGQMKHILAAEQKKTDFKPEDENNVLIQYTNACVKVCAYVRKQVEKIKNSMDGKNVDTVLMELGVRFHRLIYEHLQQYSYSCMGGMLAICDVAEYRKCAKDFKIPMVLHLFDTLHALCNLLVVAPDNLKQVCSGEQLANLDKNILHSFVQLRADYRSARLARHFS

SEQ ID NO: 29067 - protein, 804 aa, Homo sapiens
  Payload ID: 5668
  Gene Symbol: EXOC6
  Gene Name: exocyst complex component 6
  Uniprot ID: Q8TAG9
  ENSP ID: ENSP00000260762
MAENSESLGTVPEHERILQEIESTDTACVGPTLRSVYDDQPNAHKKFMEKLDACIRNHDKEIEKMCNFHHQGFVDAITELLKVRTDAEKLKVQVTDTNRRFQDAGKEVIVHTEDIIRCRIQQRNITTVVEKLQLCLPVLEMYSKLKEQMSAKRYYSALKTMEQLENVYFPWVSQYRFCQLMIENLPKLREDIKEISMSDLKDFLESIRKHSDKIGETAMKQAQHQKTFSVSLQKQNKMKFGKNMYINRDRIPEERNETVLKHSLEEEDENEEEILTVQDLVDFSPVYRCLHIYSVLGDEETFENYYRKQRKKQARLVLQPQSNMHETVDGYRRYFTQIVGFFVVEDHILHVTQGLVTRAYTDELWNMALSKIIAVLRAHSSYCTDPDLVLELKNLTVIFADTLQGYGFPVNRLFDLLFEIRDQYNETLLKKWAGVFRDIFEEDNYSPIPVVNEEEYKIVISKFPFQDPDLEKQSFPKKFPMSQSVPHIYIQVKEFIYASLKFSESLHRSSTEIDDMLRKSTNLLLTRTLSSCLLNLIRKPHIGLTELVQIIINTTHLEQACKYLEDFITNITNISQETVHTTRLYGLSTFKDARHAAEGEIYTKLNQKIDEFVQLADYDWTMSEPDGRASGYLMDLINFLRSIFQVFTHLPGKVAQTACMSACQHLSTSLMQMLLDSELKQISMGAVQQFNLDVIQCELFASSEPVPGFQGDTLQLAFIDLRQLLDLFMVWDWSTYLADYGQPASKYLRVNPNTALTLLEKMKDTSKKNNIFAQFRKNDRDKQKLIETVVKQLRSLVNGMSQHM

SEQ ID NO: 29068 - protein, 153 aa, Homo sapiens
  Payload ID: 5668
  Gene Symbol: EXOC6
  Gene Name: exocyst complex component 6
  ENSP ID: ENSP00000360598
MAENSESLGTVPEHERILQEIESTDTACVGPTLRSVYDDQPNAHKKFMEKLDACIRNHDKEIEKMCNFHHQGFVDAITELLKVRTDAEKLKVQVTDTNRRFQDAGKEVIVHTEDIIRCRIQQRNITTVVEKLQLCLPVLEMYSKLKEQMSAKR

SEQ ID NO: 29069 - protein, 799 aa, Homo sapiens
  Payload ID: 5668
  Gene Symbol: EXOC6
  Gene Name: exocyst complex component 6
  Uniprot ID: Q8TAG9
  ENSP ID: ENSP00000360607
MLEEETDQTYENVLAEIQSFELPVEATLRSVYDDQPNAHKKFMEKLDACIRNHDKEIEKMCNFHHQGFVDAITELLKVRTDAEKLKVQVTDTNRRFQDAGKEVIVHTEDIIRCRIQQRNITTVVEKLQLCLPVLEMYSKLKEQMSAKRYYSALKTMEQLENVYFPWVSQYRFCQLMIENLPKLREDIKEISMSDLKDFLESIRKHSDKIGETAMKQAQHQKTFSVSLQKQNKMKFGKNMYINRDRIPEERNETVLKHSLEEEDENEEEILTVQDLVDFSPVYRCLHIYSVLGDEETFENYYRKQRKKQARLVLQPQSNMHETVDGYRRYFTQIVGFFVVEDHILHVTQGLVTRAYTDELWNMALSKIIAVLRAHSSYCTDPDLVLELKNLTVIFADTLQGYGFPVNRLFDLLFEIRDQYNETLLKKWAGVFRDIFEEDNYSPIPVVNEEEYKIVISKFPFQDPDLEKQSFPKKFPMSQSVPHIYIQVKEFIYASLKFSESLHRSSTEIDDMLRKSTNLLLTRTLSSCLLNLIRKPHIGLTELVQIIINTTHLEQACKYLEDFITNITNISQETVHTTRLYGLSTFKDARHAAEGEIYTKLNQKIDEFVQLADYDWTMSEPDGRASGYLMDLINFLRSIFQVFTHLPGKVAQTACMSACQHLSTSLMQMLLDSELKQISMGAVQQFNLDVIQCELFASSEPVPGFQGDTLQLAFIDLRQLLDLFMVWDWSTYLADYGQPASKYLRVNPNTALTLLEKMKDTSKKNNIFAQFRKNDRDKQKLIETVVKQLRSLVNGMSQHM

SEQ ID NO: 29070 - protein, 701 aa, Homo sapiens
  Payload ID: 5668
  Gene Symbol: EXOC6
  Gene Name: exocyst complex component 6
  ENSP ID: ENSP00000396206
MAENSESLGTVPEHERILQEIESTDTACVGPTLRSVYDDQPNAHKKFMEKLDACIRNHDKEIEKMCNFHHQGFVDAITELLKVRTDAEKLKVQVTDTNRRFQDAGKEVIVHTEDIIRCRIQQRNITTVVEKLQLCLPVLEMYSKLKEQMSAKRYYSALKTMEQLENVYFPWVSQYRFCQLMIENLPKLREDIKEISMSDLKDFLESIRKHSDKIGETAMKQAQHQKTFSVSLQKQNKMKFGKNMYINRDRIPEERNETVLKHSLEEEDENEEEGDEETFENYYRKQRKKQARLVLQPQSNMGYGFPVNRLFDLLFEIRDQYNETLLKKWAGVFRDIFEEDNYSPIPVVNEEEYKIVISKFPFQDPDLEKQSFPKKFPMSQSVPHIYIQVKEFIYASLKFSESLHRSSTEIDDMLRKSTNLLLTRTLSSCLLNLIRKPHIGLTELVQIIINTTHLEQACKYLEDFITNITNISQETVHTTRLYGLSTFKDARHAAEGEIYTKLNQKIDEFVQLADYDWTMSEPDGRASGYLMDLINFLRSIFQVFTHLPGKVAQTACMSACQHLSTSLMQMLLDSELKQISMGAVQQFNLDVIQCELFASSEPVPGFQGDTLQLAFIDLRQLLDLFMVWDWSTYLADYGQPASKYLRVNPNTALTLLEKMKDTSKKNNIFAQFRKNDRDKQKLIETVVKQLRSLVNGMSQHM

SEQ ID NO: 29071 - protein, 72 aa, Homo sapiens
  Payload ID: 5668
  Gene Symbol: EXOC6
  Gene Name: exocyst complex component 6
  ENSP ID: ENSP00000398982
GKVAQTACMSACQHLSTSLMQMLLDSELKQISMGAVQQFNLDVIQCELFASSEPVPGFQGDTLQLAFIDLRQ

SEQ ID NO: 29072 - protein, 404 aa, Homo sapiens
  Payload ID: 5668
  Gene Symbol: EXOC6
  Gene Name: exocyst complex component 6
  ENSP ID: ENSP00000435649
MHETVDGYRRYFTQIVGFFVVEDHILHVTQGLVTRAYTDELWNMALSKIIAVLRAHSSYCTDPDLVLELKNLTVIFADTLQGYGFPVNRLFDLLFEIRDQYNETLLKKWAGVFRDIFEEDNYSPIPVVNEEEYKIVISKFPFQDPDLEKQSFPKKFPMSQSVPHIYIQVKEFIYASLKFSESLHRSSTEIDDMLRKSTNLLLTRTLSSCLLNLIRKPHIGLTELVQIIINTTHLEQACKYLEDFITNITNISQETVHTTRLYGLSTFKDARHAAEGEIYTKLNQKIDEFVQLADYDWTMSEPDGRASGYLMDLINFLRSIFQVFTHLPGKVAQTACMSACQHLSTSLMQMLLDSELKQISMGAVQQFNLDVIQCEYEVLLCCPDWSQTPGLKSSSCLGIPKCWN

SEQ ID NO: 29073 - protein, 811 aa, Homo sapiens
  Payload ID: 5669
  Gene Symbol: EXOC6B
  Gene Name: exocyst complex component 6B
  Uniprot ID: Q9Y2D4
  ENSP ID: ENSP00000272427
MERGKMAEAESLETAAEHERILREIESTDTACIGPTLRSVYDGEEHGRFMEKLETRIRNHDREIEKMCNFHYQGFVDSITELLKVRGEAQKLKNQVTDTNRKLQHEGKELVIAMEELKQCRLQQRNISATVDKLMLCLPVLEMYSKLRDQMKTKRHYPALKTLEHLEHTYLPQVSHYRFCKVMVDNIPKLREEIKDVSMSDLKDFLESIRKHSDKIGETAMKQAQQQRNLDNIVLQQPRIGSKRKSKKDAYIIFDTEIESTSPKSEQDSGILDVEDEEDDEEVPGAQDLVDFSPVYRCLHIYSVLGARETFENYYRKQRRKQARLVLQPPSNMHETLDGYRKYFNQIVGFFVVEDHILHTTQGLVNRAYIDELWEMALSKTIAALRTHSSYCSDPNLVLDLKNLIVLFADTLQVYGFPVNQLFDMLLEIRDQYSETLLKKWAGIFRNILDSDNYSPIPVTSEEMYKKVVGQFPFQDIELEKQPFPKKFPFSEFVPKVYNQIKEFIYACLKFSEDLHLSSTEVDDMIRKSTNLLLTRTLSNSLQNVIKRKNIGLTELVQIIINTTHLEKSCKYLEEFITNITNVLPETVHTTKLYGTTTFKDARHAAEEEIYTNLNQKIDQFLQLADYDWMTGDLGNKASDYLVDLIAFLRSTFAVFTHLPGKVAQTACMSACKHLATSLMQLLLEAEVRQLTLGALQQFNLDVRECEQFARSGPVPGFQEDTLQLAFIDLRQLLDLFIQWDWSTYLADYGQPNCKYLRVNPVTALTLLEKMKDTSRKNNMFAQFRKNERDKQKLIDTVAKQLRGLISSHHS

SEQ ID NO: 29074 - protein, 40 aa, Homo sapiens
  Payload ID: 5669
  Gene Symbol: EXOC6B
  Gene Name: exocyst complex component 6B
  ENSP ID: ENSP00000386634
MERGKMAEAESLETAAEHERILREIESTDTACIGPTLRIK

SEQ ID NO: 29075 - protein, 681 aa, Homo sapiens
  Payload ID: 5669
  Gene Symbol: EXOC6B
  Gene Name: exocyst complex component 6B
  ENSP ID: ENSP00000386698
MERGKMAEAESLETAAEHERILREIESTDTACIGPTLRSVYDGEEHGRFMEKLETRIRNHDREIEKMCNFHYQGFVDSITELLKVRGEAQKLKNQVTDTNRKLQHEGKELVIAMEELKQCRLQQRNISATVDKLMLCLPVLEMYSKLRDQMKTKRHYPALKTLEHLEHTYLPQVSHYRFCKVMVDNIPKLREEIKDVSMSDLKDFLESIRKHSDKIGETAMKQAQQQRNLDNIVLQQPRIGSKRKSKKDAYIIFDTEIESTSPKSEQDSGILDVEDEEDDEEVPGAQDLVDFSPVYRCLHIYSVLGARETFENYYRKQRRKQARLVLQPPSNMHETLDGYRKYFNQIVGFFVVEDHILHTTQGLVNRAYIDELWEMALSKTIAALRTHSSYCSDPNLVLDLKNLIVLFADTLQVYGFPVNQLFDMLLEIRDQYSETLLKKWAGIFRNILDSDNYSPIPVTSEEMYKKVVGQFPFQDIELEKQPFPKKFPFSEFVPKVYNQIKEFIYACLKFSEDLHLSSTEVDDMIRKSTNLLLTRTLSNSLQNVIKRKNIGLTELVQIIINTTHLEKSCKYLEEFITNITNVLPETVHTTKLYGTTTFKDARHAAEEEIYTNLNQKIDQFLQLADYDWMTGDLGNKASDYLVDLIAFLRSTFAVFTHLPVSGSCLLCPLYIKRFPYNLVW

SEQ ID NO: 29076 - protein, 815 aa, Homo sapiens
  Payload ID: 5669
  Gene Symbol: EXOC6B
  Gene Name: exocyst complex component 6B
  ENSP ID: ENSP00000489442
MERGKMAEAESLETAAEHERILREIESTDTACIGPTLRSVYDGEEHGRFMEKLETRIRNHDREIEKMCNFHYQGFVDSITELLKVRGEAQKLKNQVTDTNRKLQHEGKELVIAMEELKQCRLQQRNISATVDKLMLCLPVLEMYSKLRDQMKTKRHYPALKTLEHLEHTYLPQVSHYRFCKVMVDNIPKLREEIKDVSMSDLKDFLESIRKHSDKIGETAMKQAQQQRNLDNIVLQQPRIGSKRKSKKDAYIIFDTEIESTSPKSEQDSGILDVEDEEDDEEVPGAQDLVDFSPVYRCLHIYSVLGARETFENYYRKQRRKQARLVLQPPSNMHETLDGYRKYFNQIVGFFVVEDHILHTTQGLVNRAYIDELWEMALSKTIAALRTHSSYCSDPNLVLDLKNLIVLFADTLQVYGFPVNQLFDMLLEIRDQYSETLLKKWAGIFRNILDSDNYSPIPVTSEEMYKKVVGQFPFQDIELEKQPFPKKFPFSEFVPKVYNQIKEFIYACLKFSEDLHLSSTEVDDMIRKSTNLLLTRTLSNSLQNVIKRKNIGLTELVQIIINTTHLEKSCKYLEEFITNITNVLPETVHTTKLYGTTTFKDARHAAEEEIYTNLNQKIDQFLQLADYDWMTGDLGNKASDYLVDLIAFLRSTFAVFTHLPGKVAQTACMSACKHLATSLMQLLLEAEVRQLTLGALQQFNLDVRECEQFARSGPVPGFQEDTLQLAFIDLRQLLDLFIQWDWSTYLADYGQPNCKYLRVNPVTALTLLEKISREMKDTSRKNNMFAQFRKNERDKQKLIDTVAKQLRGLISSHHS

SEQ ID NO: 29077 - protein, 653 aa, Homo sapiens
  Payload ID: 5670
  Gene Symbol: EXOC7
  Gene Name: exocyst complex component 7
  Uniprot ID: Q9UPT5
  ENSP ID: ENSP00000333806
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 29078 - protein, 735 aa, Homo sapiens
  Payload ID: 5670
  Gene Symbol: EXOC7
  Gene Name: exocyst complex component 7
  Uniprot ID: Q9UPT5
  ENSP ID: ENSP00000334100
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGLLPCTPRGGLPGPWINAACVCAADISPGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 29079 - protein, 617 aa, Homo sapiens
  Payload ID: 5670
  Gene Symbol: EXOC7
  Gene Name: exocyst complex component 7
  ENSP ID: ENSP00000349767
  MOD_RES (1)..(1): Any amino acid
XSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQGKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 29080 - protein, 693 aa, Homo sapiens
  Payload ID: 5670
  Gene Symbol: EXOC7
  Gene Name: exocyst complex component 7
  ENSP ID: ENSP00000384368
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKGFNDGLEELCKIQKAWAIPDTEQRDRIRQAQKTIVKETYGAFLQKFGSVPFTKNPEKYIKYGVEQVGDMIDRLFDTSA

SEQ ID NO: 29081 - protein, 159 aa, Homo sapiens
  Payload ID: 5670
  Gene Symbol: EXOC7
  Gene Name: exocyst complex component 7
  ENSP ID: ENSP00000385066
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVVRGPQNNVRSLGISVSALVS

SEQ ID NO: 29082 - protein, 121 aa, Homo sapiens
  Payload ID: 5670
  Gene Symbol: EXOC7
  Gene Name: exocyst complex component 7
  ENSP ID: ENSP00000389723
MKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLI

SEQ ID NO: 29083 - protein, 122 aa, Homo sapiens
  Payload ID: 5670
  Gene Symbol: EXOC7
  Gene Name: exocyst complex component 7
  ENSP ID: ENSP00000389950
MAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEH

SEQ ID NO: 29084 - protein, 676 aa, Homo sapiens
  Payload ID: 5670
  Gene Symbol: EXOC7
  Gene Name: exocyst complex component 7
  Uniprot ID: Q9UPT5
  ENSP ID: ENSP00000404322
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 29085 - protein, 656 aa, Homo sapiens
  Payload ID: 5670
  Gene Symbol: EXOC7
  Gene Name: exocyst complex component 7
  ENSP ID: ENSP00000466682
MVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQVLGDTYNIPLDPRETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 29086 - protein, 33 aa, Homo sapiens
  Payload ID: 5670
  Gene Symbol: EXOC7
  Gene Name: exocyst complex component 7
  ENSP ID: ENSP00000467042
SGVPYSPAIPNKRKDTPTKKPVKRPGCPGWADA

SEQ ID NO: 29087 - protein, 168 aa, Homo sapiens
  Payload ID: 5670
  Gene Symbol: EXOC7
  Gene Name: exocyst complex component 7
  ENSP ID: ENSP00000468364
MCPQYLSQSPNPSCPTAFSWNLPWEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEA

SEQ ID NO: 29088 - protein, 684 aa, Homo sapiens
  Payload ID: 5670
  Gene Symbol: EXOC7
  Gene Name: exocyst complex component 7
  Uniprot ID: Q9UPT5
  ENSP ID: ENSP00000468404
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 29089 - protein, 656 aa, Homo sapiens; identical to SEQ ID NO: 29085
  Payload ID: 5670
  Gene Symbol: EXOC7
  Gene Name: exocyst complex component 7
  ENSP ID: ENSP00000475431

SEQ ID NO: 29090 - protein, 707 aa, Homo sapiens
  Payload ID: 5670
  Gene Symbol: EXOC7
  Gene Name: exocyst complex component 7
  ENSP ID: ENSP00000489266
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPNKRKDTPTKKPVKRPGTIRKAQNLLKQYSQHGLDGKKGGSNLIPLEGHEHDFRVKHLSEALNDKHGPLAGRDDMLDVETDAYIHCVSAFVKLAQSEYQLLADIIPEHHQKKTFDSLIQDALDGLMLEGENIVSAARKAIVRHDFSTVLTVFPILRHLKQTKPEFDQVLQGTAASTKNKLPGLITSMETIGAKALEDFADNIKNDPDKEYNMPKDGTVHELTSNAILFLQQLLDFQETAGAMLASQETSSSATSYSSEFSKRLLSTYICKVLGNLQLNLLSKSKVYEDPALSAIFLHNNYNYILKSLEKSELIQLVAVTQKTAERSYREHIEQQIQTYQRSWLKVTDYIAEKNLPVFQPGVKLRDKERQIIKERFKGFNDGLEELCKIQKAWAIPDTEQRDRIRQAQKTIVKETYGAFLQKFGSVPFTKNPEKYIKYGVEQVGDMIDRLFDTSA

SEQ ID NO: 29091 - protein, 725 aa, Homo sapiens
  Payload ID: 5671
  Gene Symbol: EXOC8
  Gene Name: exocyst complex component 8
  Uniprot ID: Q8IYI6
  ENSP ID: ENSP00000355605
MAMAMSDSGASRLRRQLESGGFEARLYVKQLSQQSDGDRDLQEHRQRIQALAEETAQNLKRNVYQNYRQFIETAREISYLESEMYQLSHLLTEQKSSLESIPLTLLPAAAAAGAAAASGGEEGVGGAGGRDHLRGQAGFFSTPGGASRDGSGPGEEGKQRTLTTLLEKVEGCRHLLETPGQYLVYNGDLVEYDADHMAQLQRVHGFLMNDCLLVATWLPQRRGMYRYNALYSLDGLAVVNVKDNPPMKDMFKLLMFPESRIFQAENAKIKREWLEVLEDTKRALSEKRRREQEEAAAPRGPPQVTSKATNPFEDDEEEEPAVPEVEEEKVDLSMEWIQELPEDLDVCIAQRDFEGAVDLLDKLNHYLEDKPSPPPVKELRAKVEERVRQLTEVLVFELSPDRSLRGGPKATRRAVSQLIRLGQCTKACELFLRNRAAAVHTAIRQLRIEGATLLYIHKLCHVFFTSLLETAREFEIDFAGTDSGCYSAFVVWARSAMGMFVDAFSKQVFDSKESLSTAAECVKVAKEHCQQLGDIGLDLTFIIHALLVKDIQGALHSYKEIIIEATKHRNSEEMWRRMNLMTPEALGKLKEEMKSCGVSNFEQYTGDDCWVNLSYTVVAFTKQTMGFLEEALKLYFPELHMVLLESLVEIILVAVQHVDYSLRCEQDPEKKAFIRQNASFLYETVLPVVEKRFEEGVGKPAKQLQDLRNASRLIRVNPESTTSVV

SEQ ID NO: 29092 - protein, 846 aa, Homo sapiens
  Payload ID: 5672
  Gene Symbol: EXO1
  Gene Name: exonuclease 1
  Uniprot ID: Q9UQ84
  ENSP ID: ENSP00000311873
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 29093 - protein, 846 aa, Homo sapiens; identical to SEQ ID NO: 29092
  Payload ID: 5672
  Gene Symbol: EXO1
  Gene Name: exonuclease 1
  Uniprot ID: Q9UQ84
  ENSP ID: ENSP00000355506

SEQ ID NO: 29094 - protein, 135 aa, Homo sapiens
  Payload ID: 5672
  Gene Symbol: EXO1
  Gene Name: exonuclease 1
  ENSP ID: ENSP00000406652
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIK

SEQ ID NO: 29095 - protein, 166 aa, Homo sapiens
  Payload ID: 5672
  Gene Symbol: EXO1
  Gene Name: exonuclease 1
  ENSP ID: ENSP00000412041
MGIQGLLQFIKEASEPIHVRKYKGQVVAVDTYCWLHKGAIACAEKLAKGEPTDRRRQANLLKGKQLLREGKVSEARECFTRSINITHAMAHKAARSQGVDCLVAPYEADAQLAYLNKAGIVQAIITEDSDLLAFGCKKVILKMDQFGNGLEIDQARLGMCRQLGDV

SEQ ID NO: 29096 - protein, 169 aa, Homo sapiens
  Payload ID: 5672
  Gene Symbol: EXO1
  Gene Name: exonuclease 1
  ENSP ID: ENSP00000415531
MGIQGLLQFIKEASEPIHVRKYKGQVVAVDTYCWLHKGAIACAEKLAKGEPTDRRRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDV

SEQ ID NO: 29097 - protein, 208 aa, Homo sapiens
  Payload ID: 5672
  Gene Symbol: EXO1
  Gene Name: exonuclease 1
  ENSP ID: ENSP00000428326
  MOD_RES (1)..(1): Any amino acid
XGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRA

SEQ ID NO: 29098 - protein, 11 aa, Homo sapiens
  Payload ID: 5672
  Gene Symbol: EXO1
  Gene Name: exonuclease 1
  ENSP ID: ENSP00000429720
MGIQGLLQFIK

SEQ ID NO: 29099 - protein, 95 aa, Homo sapiens
  Payload ID: 5672
  Gene Symbol: EXO1
  Gene Name: exonuclease 1
  ENSP ID: ENSP00000430082
MGIQGLLQFIKEASEPIHVRKYKGQVVAVDTYCWLHKGAIACAEKLAKGEPTDRRRQANLLKGKQLLREGKVSEARECFTRSINITHAMAHKVIK

SEQ ID NO: 29100 - protein, 803 aa, Homo sapiens
  Payload ID: 5672
  Gene Symbol: EXO1
  Gene Name: exonuclease 1
  Uniprot ID: Q9UQ84
  ENSP ID: ENSP00000430251
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKF

SEQ ID NO: 29101 - protein, 514 aa, Homo sapiens
  Payload ID: 5673
  Gene Symbol: EXD1
  Gene Name: exonuclease 3'-5' domain containing 1
  Uniprot ID: Q8NHP7
  ENSP ID: ENSP00000321029
MEDSEFLAYVELLDEVEQGSVRAKASSVSLHAERTWMEKMKVEDLNVCEPASPAPEAPATSLLNDLKYSPSEEEEVTYTVINQFQQKFGAAILHIKKQNVLSVAAEGANVCRHGKLCWLQVATNCRVYLFDIFLLGSRAFHNGLQMILEDKRILKVIHDCRWLSDCLSHQYGILLNNVFDTQVADVLQFSMETGGYLPNCITTLQESLIKHLQVAPKYLSFLEKRQKLIQENPEVWFIRPVSPSLLKILALEATYLLPLRLALLDEMMSDLTTLVDGYLNTYREGSADRLGGTEPTCMELPEELLQLKDFQKQRREKAAREYRVNAQGLLIRTVLQPKKLVTETAGKEEKVKGFLFGKNFRIDKAPSFTSQDFHGDVNLLKEESLNKQATNPQHLPPTEEGETSEDSSNKLICTKSKGSEDQRITQKEHFMTPKHEFQASLSLKEETEQLLMVENKEDLKCTKQAVSMSSFPQETRVSPSDTFYPIRKTVVSTLPPCPALEKIDSWISPFLNLP

SEQ ID NO: 29102 - protein, 572 aa, Homo sapiens
  Payload ID: 5673
  Gene Symbol: EXD1
  Gene Name: exonuclease 3'-5' domain containing 1
  Uniprot ID: Q8NHP7
  ENSP ID: ENSP00000415056
MDPSSDYHFLSQILWKRVKLTLVCGVFEGVLQHVDPNKIVVLKKVKNVETGRSVPGVKLFFGHEIVNVELLDEVEQGSVRAKASSVSLHAERTWMEKMKVEDLNVCEPASPAPEAPATSLLNDLKYSPSEEEEVTYTVINQFQQKFGAAILHIKKQNVLSVAAEGANVCRHGKLCWLQVATNCRVYLFDIFLLGSRAFHNGLQMILEDKRILKVIHDCRWLSDCLSHQYGILLNNVFDTQVADVLQFSMETGGYLPNCITTLQESLIKHLQVAPKYLSFLEKRQKLIQENPEVWFIRPVSPSLLKILALEATYLLPLRLALLDEMMSDLTTLVDGYLNTYREGSADRLGGTEPTCMELPEELLQLKDFQKQRREKAAREYRVNAQGLLIRTVLQPKKLVTETAGKEEKVKGFLFGKNFRIDKAPSFTSQDFHGDVNLLKEESLNKQATNPQHLPPTEEGETSEDSSNKLICTKSKGSEDQRITQKEHFMTPKHEFQASLSLKEETEQLLMVENKEDLKCTKQAVSMSSFPQETRVSPSDTFYPIRKTVVSTLPPCPALEKIDSWISPFLNLP

SEQ ID NO: 29103 - protein, 55 aa, Homo sapiens
  Payload ID: 5673
  Gene Symbol: EXD1
  Gene Name: exonuclease 3'-5' domain containing 1
  ENSP ID: ENSP00000452678
MDPSSDYHFLSQILWKRVKLTLVCGVFEGVLQHVDPNKIVVLKKVELLDEVEQGS

SEQ ID NO: 29104 - protein, 621 aa, Homo sapiens
  Payload ID: 5674
  Gene Symbol: EXD2
  Gene Name: exonuclease 3'-5' domain containing 2
  Uniprot ID: Q9NVH0
  ENSP ID: ENSP00000313140
MSRQNLVALTVTTLLGVAVGGFVLWKGIQRRRRSKTSPVTQQPQQKVLGSRELPPPEDDQLHSSAPRSSWKERILKAKVVTVSQEAEWDQIEPLLRSELEDFPVLGIDCEWVNLEGKASPLSLLQMASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQVIYAARDAQISVALFLHLLGYPFSRNSPGEKNDDHSSWRKVLEKCQGVVDIPFRSKGMSRLGEEVNGEATESQQKPRNKKSKMDGMVPGNHQGRDPRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSCHAISNYYDNHLKQQLAKEFQAPIGSEEGLRLLEDPERRQVRSGARALLNAESLPTQRKEELLQALREFYNTDVVTEEMLQEAASLETRISNENYVPHGLKVVQCHSQGGLRSLMQLESRWRQHFLDSMQPKHLPQQWSVDHNHQKLLRKFGEDLPIQLS

SEQ ID NO: 29105 - protein, 496 aa, Homo sapiens
  Payload ID: 5674
  Gene Symbol: EXD2
  Gene Name: exonuclease 3'-5' domain containing 2
  Uniprot ID: Q9NVH0
  ENSP ID: ENSP00000386632
MASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQVIYAARDAQISVALFLHLLGYPFSRNSPGEKNDDHSSWRKVLEKCQGVVDIPFRSKGMSRLGEEVNGEATESQQKPRNKKSKMDGMVPGNHQGRDPRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSCHAISNYYDNHLKQQLAKEFQAPIGSEEGLRLLEDPERRQVRSGARALLNAESLPTQRKEELLQALREFYNTDVVTEEMLQEAASLETRISNENYVPHGLKVVQCHSQGGLRSLMQLESRWRQHFLDSMQPKHLPQQWSVDHNHQKLLRKFGEDLPIQLS

SEQ ID NO: 29106 - protein, 496 aa, Homo sapiens; identical to SEQ ID NO: 29105
  Payload ID: 5674
  Gene Symbol: EXD2
  Gene Name: exonuclease 3'-5' domain containing 2
  Uniprot ID: Q9NVH0
  ENSP ID: ENSP00000386762

SEQ ID NO: 29107 - protein, 496 aa, Homo sapiens; identical to SEQ ID NO: 29105
  Payload ID: 5674
  Gene Symbol: EXD2
  Gene Name: exonuclease 3'-5' domain containing 2
  Uniprot ID: Q9NVH0
  ENSP ID: ENSP00000386839

SEQ ID NO: 29108 - protein, 496 aa, Homo sapiens; identical to SEQ ID NO: 29105
  Payload ID: 5674
  Gene Symbol: EXD2
  Gene Name: exonuclease 3'-5' domain containing 2
  Uniprot ID: Q9NVH0
  ENSP ID: ENSP00000386915

SEQ ID NO: 29109 - protein, 621 aa, Homo sapiens; identical to SEQ ID NO: 29104
  Payload ID: 5674
  Gene Symbol: EXD2
  Gene Name: exonuclease 3'-5' domain containing 2
  Uniprot ID: Q9NVH0
  ENSP ID: ENSP00000387331

SEQ ID NO: 29110 - protein, 114 aa, Homo sapiens
  Payload ID: 5674
  Gene Symbol: EXD2
  Gene Name: exonuclease 3'-5' domain containing 2
  ENSP ID: ENSP00000409089
MASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQ

SEQ ID NO: 29111 - protein, 876 aa, Homo sapiens
  Payload ID: 5675
  Gene Symbol: EXD3
  Gene Name: exonuclease 3'-5' domain containing 3
  Uniprot ID: Q8N9H8
  ENSP ID: ENSP00000340474
MDPGDPAGDPAAGERHRMGRDPLLLLQALQTLWSTRERKQLREEAWRGFAALDDPLAGLLDMLESCRGQRGEGPSLAAWISHQLQCWLQAQPCPSLAQHSLRLKQLQARAVKVLTESPPSLAAPLASIFQLQDADRSCLLAHVHRLHHEGRFREAATLGATLKLQSELGVEKMSIPLLLQDKVALVERYVAGFPDLQRRLLVLMDSWCQPGFDIKDVARRYPEVTSLSLEKLSPKALSRQVLRLQERYGVAPALCPNAAIQQRLAALRHLCHKRFVEKSLSQENWTDHVQGLVGQSPWLQEQLSQLLVSHSDPVTAAQCAMELLLPEERLPAAVAVELRRFRLQGRATEADSRLEVKDMKDRYYQLPIPRENVHLLASWEDLTRHEGALLQCHQVVGVDVEWTPVFVAGGRPRPSLLQVAVEGHVFLLDVLALSQPPTGQGAQAFSRLVAQLLSDPSITKLGYGMVGDLQKLGTSCPALAHVEKQILGGMDLLLVHRQMRVASVPAPAVDRARELRGLSLLVQQVLGTALDKTQQLSNWDRRPLCEEQVIYAAADAYCLLEVHQALCREPARFHLSEDLAGSRRPRHRERPGARKPPGLQKASAPAAPRQVPVAVAVSEGAAPQIPARAFRVVCDNMLQGLARSLRCLGVDARMLGNGEDHRRAAEVARQEGRIILTSGQPFHKLRAQVGAGRCLSVDCSLKAQQQAKAVLKHFNVRVTHADIFSRCQACNCDQYLKVSRDMMKQLMWLSSHQEGPRSSGDEATQSQAVQEPGPAPDAAPEGCTYDRPCRWLQMADLRAETPDMLADGTRLQLAGVPVGVLRTPGLRCFYCCTGCGKVFWDGSHLGRVATHFRDMLESAPSPCEPSPAPSPASSPF

SEQ ID NO: 29112 - protein, 246 aa, Homo sapiens
  Payload ID: 5675
  Gene Symbol: EXD3
  Gene Name: exonuclease 3'-5' domain containing 3
  Uniprot ID: Q8N9H8
  ENSP ID: ENSP00000431859
MDPGDPAGDPAAGERHRMGRDPLLLLQALQTLWSTRERKQLREEAWRGFAALDDPLAGLLDMLESCRGQRGEGPSLAAWISHQLQCWLQAQPCPSLAQHSLRLKQLQARAVKVLTESPPSLAAPLASIFQLQDADRSCLLAHVHRLHHEGRFREAATLGATLKLQSELGVEKMSIPLLLQDKVALVERYVAGFPDLQRRLLVLMDSWCQPGFDIKDVASCHVTAAGAAASGEERLGLAGAQPSSPE

SEQ ID NO: 29113 - protein, 56 aa, Homo sapiens
  Payload ID: 5675
  Gene Symbol: EXD3
  Gene Name: exonuclease 3'-5' domain containing 3
  ENSP ID: ENSP00000432895
MDPGDPAGDPAAGERHRMGTHRLLQPLLHLSRVGCFQSATPQLAGPLEQPRRPLEH

SEQ ID NO: 29114 - protein, 36 aa, Homo sapiens
  Payload ID: 5675
  Gene Symbol: EXD3
  Gene Name: exonuclease 3'-5' domain containing 3
  ENSP ID: ENSP00000433010
  MOD_RES (1)..(1): Any amino acid
XMDSWCQPGFDIKDVASFWKHLVCDVCQQLQRKGST

SEQ ID NO: 29115 - protein, 140 aa, Homo sapiens
  Payload ID: 5675
  Gene Symbol: EXD3
  Gene Name: exonuclease 3'-5' domain containing 3
  ENSP ID: ENSP00000435830
MSIPLLLQDKVALVERYVAGFPDLQRRLLVLMDSWCQPGFDIKDVARRYPEVTSLSLEKLSPKALSRQVLRLQERYGVAPALCPNAAIQQRLAALRHLCHKRFVEVREQEGVLGAASRGLSHRVWPGILTAHCRVHRHIK

SEQ ID NO: 29116 - protein, 40 aa, Homo sapiens
  Payload ID: 5675
  Gene Symbol: EXD3
  Gene Name: exonuclease 3'-5' domain containing 3
  ENSP ID: ENSP00000436717
MDPGDPAGDPAAGERHRMGRDPLLLLQALQTLWSTRERKQ

SEQ ID NO: 29117 - protein, 373 aa, Homo sapiens
  Payload ID: 5676
  Gene Symbol: EXO5
  Gene Name: exonuclease 5
  Uniprot ID: Q9H790
  ENSP ID: ENSP00000296380
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEGHIREFPVFGEGEGVLLVGVIDELHYTAKGELELAELKTRRRPMLPLEAQKKKDCFQVSLYKYIFDAMVQGKVTPASLIHHTKLCLEKPLGPSVLRHAQQGGFSVKSLGDLMELVFLSLTLSDLPVIDILKIEYIHQETATVLGTEIVAFKEKEVRAKVQHYMAYWMGHREPQGVDVEEAWKCRTCTYADICEWRKGSGVLSSTLAPQVKKAK

SEQ ID NO: 29118 - protein, 373 aa, Homo sapiens; identical to SEQ ID NO: 29117
  Payload ID: 5676
  Gene Symbol: EXO5
  Gene Name: exonuclease 5
  Uniprot ID: Q9H790
  ENSP ID: ENSP00000351328

SEQ ID NO: 29119 - protein, 373 aa, Homo sapiens; identical to SEQ ID NO: 29117
  Payload ID: 5676
  Gene Symbol: EXO5
  Gene Name: exonuclease 5
  Uniprot ID: Q9H790
  ENSP ID: ENSP00000361788

SEQ ID NO: 29120 - protein, 224 aa, Homo sapiens
  Payload ID: 5676
  Gene Symbol: EXO5
  Gene Name: exonuclease 5
  ENSP ID: ENSP00000391240
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEGHIREFPVFGEGEGVLLVGVIDELHYTAKGELELAELKTRRRPMLPLEAQKKKDCFQVSLYKYI

SEQ ID NO: 29121 - protein, 247 aa, Homo sapiens
  Payload ID: 5676
  Gene Symbol: EXO5
  Gene Name: exonuclease 5
  ENSP ID: ENSP00000392115
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEGHIREFPVFGEGEGVLLVGVIDELHYTAKGELELAELKTRRRPMLPLEAQKKKDCFQVSLYKYIFDAMVQGKVTPASLIHHTKLCLE

SEQ ID NO: 29122 - protein, 226 aa, Homo sapiens
  Payload ID: 5676
  Gene Symbol: EXO5
  Gene Name: exonuclease 5
  ENSP ID: ENSP00000398437
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEGHIREFPVFGEGEGVLLVGVIDELHYTAKGELELAELKTRRRPMLPLEAQKKKDCFQVSLYKYIFD

SEQ ID NO: 29123 - protein, 247 aa, Homo sapiens; identical to SEQ ID NO: 29121
  Payload ID: 5676
  Gene Symbol: EXO5
  Gene Name: exonuclease 5
  ENSP ID: ENSP00000409715

SEQ ID NO: 29124 - protein, 161 aa, Homo sapiens
  Payload ID: 5676
  Gene Symbol: EXO5
  Gene Name: exonuclease 5
  ENSP ID: ENSP00000413565
MAETREEETVSAEASGFSDLSDSEFLEFLDLEDAQESKALVNMPGPSSESLGKDDKPISLQNWKRGLDILSPMERFHLKYLYVTDLATQNWCELQTAYGKELPGFLAPEKAAVLDTGASIHLARELELHDLVTVPVTTKEDAWAIKFLNILLLIPTLQSEG

SEQ ID NO: 29125 - protein, 100 aa, Homo sapiens
  Payload ID: 5676
  Gene Symbol: EXO5
  Gene Name: exonuclease 5
  ENSP ID: ENSP00000416857
MAETREEETVSAEASGFSDLSDSEFLEFLDLEDAQESKALVNMPGPSSESLGKDDKPISLQNWKRGLDILSPMERFHLKYLYVTDLATQNWCELQTAYGK

SEQ ID NO: 29126 - protein, 1989 aa, Homo sapiens
  Payload ID: 5677
  Gene Symbol: EXPH5
  Gene Name: exophilin 5
  Uniprot ID: Q8NEV8
  ENSP ID: ENSP00000265843
MTKVPPAFDFSFLNDEEARKILQVLERNEELQRAEKDRISKLQKTKRDIRWLQGVTGEWFEEIQRKKFCNETDVSQMLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENGKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRKSHPPKVRERHFSESTSIDNALSRLTLGNEFSVNNGYSRRFRSFSELPSCDGNESWAYRSGTKTGPRSAISIYRPIDYGIFGKEQQLAFLENVKRSLTQGRLWKPSFLKNPGFLKDDLRNPPNPSESLSSNSPSSQVPEDGLSPSEPLNIYEDDPVDSDCDTDTTTDDEYYLDENDKESEL

SEQ ID NO: 29127 - protein, 1982 aa, Homo sapiens
  Payload ID: 5677
  Gene Symbol: EXPH5
  Gene Name: exophilin 5
  Uniprot ID: Q8NEV8
  ENSP ID: ENSP00000432546
MSLSFLNDEEARKILQVLERNEELQRAEKDRISKLQKTKRDIRWLQGVTGEWFEEIQRKKFCNETDVSQMLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENGKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRKSHPPKVRERHFSESTSIDNALSRLTLGNEFSVNNGYSRRFRSFSELPSCDGNESWAYRSGTKTGPRSAISIYRPIDYGIFGKEQQLAFLENVKRSLTQGRLWKPSFLKNPGFLKDDLRNPPNPSESLSSNSPSSQVPEDGLSPSEPLNIYEDDPVDSDCDTDTTTDDEYYLDENDKESEL

SEQ ID NO: 29128 - protein, 1733 aa, Homo sapiens
  Payload ID: 5677
  Gene Symbol: EXPH5
  Gene Name: exophilin 5
  ENSP ID: ENSP00000432683
MLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENGKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRK

SEQ ID NO: 29129 - protein, 79 aa, Homo sapiens
  Payload ID: 5677
  Gene Symbol: EXPH5
  Gene Name: exophilin 5
  ENSP ID: ENSP00000433909
MLKQPLTYRLSKEMAKNDPIELPTSRSKNVTNQKKPTPFSSRMSFRSSFASLFSFRKSGKETSKLPSLGQKGCDGHAGP

SEQ ID NO: 29130 - protein, 1192 aa, Homo sapiens
  Payload ID: 5677
  Gene Symbol: EXPH5
  Gene Name: exophilin 5
  ENSP ID: ENSP00000446434
MREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSE

SEQ ID NO: 29131 - protein, 544 aa, Homo sapiens
  Payload ID: 5677
  Gene Symbol: EXPH5
  Gene Name: exophilin 5
  ENSP ID: ENSP00000482691
MPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNE

SEQ ID NO: 29132 - protein, 349 aa, Homo sapiens
  Payload ID: 5678
  Gene Symbol: ERI1
  Gene Name: exoribonuclease 1
  Uniprot ID: Q8IV48
  ENSP ID: ENSP00000250263
MEDPQSKEPAGEAVALALLESPRPEGGEEPPRPSPEETQQCKFDGQETKGSKFITSSASDFSDPVYKEIAITNGCINRMSKEELRAKLSEFKLETRGVKDVLKKRLKNYYKKQKLMLKESNFADSYYDYICIIDFEATCEEGNPPEFVHEIIEFPVVLLNTHTLEIEDTFQQYVRPEINTQLSDFCISLTGITQDQVDRADTFPQVLKKVIDWMKLKELGTKYKYSLLTDGSWDMSKFLNIQCQLSRLKYPPFAKKWINIRKSYGNFYKVPRSQTKLTIMLEKLGMDYDGRPHCGLDDSKNIARIAVRMLQDGCELRINEKMHAGQLMSVSSSLPIEGTPPPQMPHFRK

SEQ ID NO: 29133 - protein, 44 aa, Homo sapiens
  Payload ID: 5678
  Gene Symbol: ERI1
  Gene Name: exoribonuclease 1
  ENSP ID: ENSP00000429043
MEDPQSKEPAGEAVALALLESPRPEGGEEPPRPSPECPSLPCVL

SEQ ID NO: 29134 - protein, 349 aa, Homo sapiens; identical to SEQ ID NO: 29132
  Payload ID: 5678
  Gene Symbol: ERI1
  Gene Name: exoribonuclease 1
  Uniprot ID: Q8IV48
  ENSP ID: ENSP00000429615

SEQ ID NO: 29135 - protein, 349 aa, Homo sapiens; identical to SEQ ID NO: 29132
  Payload ID: 5678
  Gene Symbol: ERI1
  Gene Name: exoribonuclease 1
  Uniprot ID: Q8IV48
  ENSP ID: ENSP00000430190

SEQ ID NO: 29136 - protein, 99 aa, Homo sapiens
  Payload ID: 5678
  Gene Symbol: ERI1
  Gene Name: exoribonuclease 1
  ENSP ID: ENSP00000430651
MEDPQSKEPAGEAVALALLESPRPEGGEEPPRPSPEETQQCKFDGQETKGSKFITSSASDFSDPVYKEIAITNGCINRMSKEELRAKLSEFKLETRYNL

SEQ ID NO: 29137 - protein, 165 aa, Homo sapiens
  Payload ID: 5679
  Gene Symbol: EXOSC1
  Gene Name: exosome component 1
  ENSP ID: ENSP00000359921
  MOD_RES (1)..(1): Any amino acid
XFHPGFGTAAIMAPPVRYCIPGERLCNLEEGSPGSGTYTRHGYIFSSLAGCLMKSSENGALPVVSVVRETESQLLPDVGAIVTCKVEIYKSFRPGDIVLAKVISLGDAQSNYLLTTAENELGVVVAHSESGIQMVPISWCEMQCPKTHTKEFRKVARVQPEFLQT

SEQ ID NO: 29138 - protein, 170 aa, Homo sapiens
  Payload ID: 5679
  Gene Symbol: EXOSC1
  Gene Name: exosome component 1
  ENSP ID: ENSP00000359922
MAPPVRYCIPGERLCNLEEGSPGSGTYTRHGYIFSSLAGCLMKSSENGAVSSINSRFAKVHILYVGSMPLKNSFRGTIRKEDVRATEKDKVEIYKSFRPGDIVLAKVISLGDAQSNYLLTTAENELGVVVAHSESGIQMVPISWCEMQCPKTHTKEFRKVARVQPEFLQT

SEQ ID NO: 29139 - protein, 178 aa, Homo sapiens
  Payload ID: 5679
  Gene Symbol: EXOSC1
  Gene Name: exosome component 1
  ENSP ID: ENSP00000359923
MAPPVRYCIPGERLCNLEEGSPGSGTYTRHGYIFSSLAGCLMKSSENGALPVVSVVRETESQLLPDVGAIVTCKVSSINSRFAKVHILYVGSMPLKNSFRGTIRKEDVRATEKDKISLGDAQSNYLLTTAENELGVVVAHSESGIQMVPISWCEMQCPKTHTKEFRKVARVQPEFLQT

SEQ ID NO: 29140 - protein, 195 aa, Homo sapiens
  Payload ID: 5679
  Gene Symbol: EXOSC1
  Gene Name: exosome component 1
  Uniprot ID: Q9Y3B2
  ENSP ID: ENSP00000359939
MAPPVRYCIPGERLCNLEEGSPGSGTYTRHGYIFSSLAGCLMKSSENGALPVVSVVRETESQLLPDVGAIVTCKVSSINSRFAKVHILYVGSMPLKNSFRGTIRKEDVRATEKDKVEIYKSFRPGDIVLAKVISLGDAQSNYLLTTAENELGVVVAHSESGIQMVPISWCEMQCPKTHTKEFRKVARVQPEFLQT

SEQ ID NO: 29141 - protein, 143 aa, Homo sapiens
  Payload ID: 5679
  Gene Symbol: EXOSC1
  Gene Name: exosome component 1
  ENSP ID: ENSP00000473303
  MOD_RES (1)..(1): Any amino acid
XGERLCNLEEGSPGSGTYTRHGYIFSSLAGCLMKSSENGALPVVSVVRETESQLLPDVGAIVTCKVSSINSRFAKVHILYVGSMPLKNSFRGTIRKEDVRATEKDKVVGIQMVPISWCEMQCPKTHTKEFRKVARVQPEFLQT

SEQ ID NO: 29142 - protein, 139 aa, Homo sapiens
  Payload ID: 5679
  Gene Symbol: EXOSC1
  Gene Name: exosome component 1
  ENSP ID: ENSP00000473660
MAPPVRYCIPGERLCNLEEGSPGSGTYTRHGYIFSSLAGCLMKSSENGALPVVSVVRETESQLLPDVGAIVTCKVSSINSRFAKVHILYVGSMPLKNSFRGTIRKEDVRATEKDKVSRWFPSAGVRCSALRPTLKNSGK

SEQ ID NO: 29143 - protein, 860 aa, Homo sapiens
  Payload ID: 5680
  Gene Symbol: EXOSC10
  Gene Name: exosome component 10
  Uniprot ID: Q01780
  ENSP ID: ENSP00000307307
MAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 29144 - protein, 885 aa, Homo sapiens
  Payload ID: 5680
  Gene Symbol: EXOSC10
  Gene Name: exosome component 10
  Uniprot ID: Q01780
  ENSP ID: ENSP00000366135
MAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 29145 - protein, 124 aa, Homo sapiens
  Payload ID: 5680
  Gene Symbol: EXOSC10
  Gene Name: exosome component 10
  ENSP ID: ENSP00000465008
MAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERV

SEQ ID NO: 29146 - protein, 200 aa, Homo sapiens
  Payload ID: 5681
  Gene Symbol: EXOSC2
  Gene Name: exosome component 2
  ENSP ID: ENSP00000361425
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISAEVQAVFSDGAVSLHTRSLKYGKTHFHDLPCGASVILGNNGFIWIYPTPEHKEEEAGG

SEQ ID NO: 29147 - protein, 263 aa, Homo sapiens
  Payload ID: 5681
  Gene Symbol: EXOSC2
  Gene Name: exosome component 2
  Uniprot ID: Q13868
  ENSP ID: ENSP00000361426
MAMEMRLPVARKPLSERLGRDTKKHLVVPGDTITTDTGFMRGHGTYMGEEKLIASVAGSVERVNKLICVKALKTRYIGEVGDIVVGRITERRRSAEDELAMRGFLQEGDLISAEVQAVFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 29148 - protein, 285 aa, Homo sapiens
  Payload ID: 5681
  Gene Symbol: EXOSC2
  Gene Name: exosome component 2
  ENSP ID: ENSP00000361427
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISAEVQAVFSDGAVSLHTRSLKYGKVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 29149 - protein, 293 aa, Homo sapiens
  Payload ID: 5681
  Gene Symbol: EXOSC2
  Gene Name: exosome component 2
  Uniprot ID: Q13868
  ENSP ID: ENSP00000361433
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISAEVQAVFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 29150 - protein, 237 aa, Homo sapiens
  Payload ID: 5681
  Gene Symbol: EXOSC2
  Gene Name: exosome component 2
  ENSP ID: ENSP00000418463
  MOD_RES (1)..(1): Any amino acid
XRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQ

SEQ ID NO: 29151 - protein, 267 aa, Homo sapiens
  Payload ID: 5681
  Gene Symbol: EXOSC2
  Gene Name: exosome component 2
  Uniprot ID: Q13868
  ENSP ID: ENSP00000444917
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 29152 - protein, 275 aa, Homo sapiens
  Payload ID: 5682
  Gene Symbol: EXOSC3
  Gene Name: exosome component 3
  Uniprot ID: Q9NQT5
  ENSP ID: ENSP00000323046
MAEPASVAAESLAGSRARAARTVLGQVVLPGEELLLPEQEDAEGPGGAVERPLSLNARACSRVRVVCGPGLRRCGDRLLVTKCGRLRHKEPGSGSGGGVYWVDSQQKRYVPVKGDHVIGIVTAKSGDIFKVDVGGSEPASLSYLSFEGATKRNRPNVQVGDLIYGQFVVANKDMEPEMVCIDSCGRANGMGVIGQDGLLFKVTLGLIRKLLAPDCEIIQEVGKLYPLEIVFGMNGRIWVKAKTIQQTLILANILEACEHMTSDQRKQIFSRLAES

SEQ ID NO: 29153 - protein, 164 aa, Homo sapiens
  Payload ID: 5682
  Gene Symbol: EXOSC3
  Gene Name: exosome component 3
  Uniprot ID: Q9NQT5
  ENSP ID: ENSP00000379775
MAEPASVAAESLAGSRARAARTVLGQVVLPGEELLLPEQEDAEGPGGAVERPLSLNARACSRVRVVCGPGLRRCGDRLLVTKCGRLRHKEPGSGSGGGVYWVDSQQKRYVPVKGDHVIGIVTAKSGDIFKVDVGGSEPASLSYLSFEGATKRNRPNVQAISSRL

SEQ ID NO: 29154 - protein, 164 aa, Homo sapiens; identical to SEQ ID NO: 29153
  Payload ID: 5682
  Gene Symbol: EXOSC3
  Gene Name: exosome component 3
  Uniprot ID: Q9NQT5
  ENSP ID: ENSP00000418422

SEQ ID NO: 29155 - protein, 245 aa, Homo sapiens
  Payload ID: 5683
  Gene Symbol: EXOSC4
  Gene Name: exosome component 4
  Uniprot ID: Q9NPD3
  ENSP ID: ENSP00000315476
MAGLELLSDQGYRVDGRRAGELRKIQARMGVFAQADGSAYIEQGNTKALAVVYGPHEIRGSRARALPDRALVNCQYSSATFSTGERKRRPHGDRKSCEMGLQLRQTFEAAILTQLHPRSQIDIYVQVLQADGGTYAACVNAATLAVLDAGIPMRDFVCACSAGFVDGTALADLSHVEEAAGGPQLALALLPASGQIALLEMDARLHEDHLERVLEAAAQAARDVHTLLDRVVRQHVREASILLGD

SEQ ID NO: 29156 - protein, 156 aa, Homo sapiens
  Payload ID: 5683
  Gene Symbol: EXOSC4
  Gene Name: exosome component 4
  ENSP ID: ENSP00000432661
MAGLELLSDQGYRVDGRRAGELRKIQARMGVFAQADGSAYIEQGNTKALAVVYGPHEIRGSRARALPDRALVNCQYSSATFSTGATGRWWDLCSLCECSHAGSAGCRDTHERLCVCVLSWLRGRHSPGGPQPCGGSSWWPPAGPGPAASLRTDCAA

SEQ ID NO: 29157 - protein, 261 aa, Homo sapiens
  Payload ID: 5683
  Gene Symbol: EXOSC4
  Gene Name: exosome component 4
  ENSP ID: ENSP00000436539
MFVNLGWQGMGQGWTQGSQLKGARGRHMQDRERKTGGFVLEVTQLPLAEALKVEGEADPQRTVECELEGVGLAHVSVLFQIRGSRARALPDRALVNCQYSSATFSTGERKRRPHGDRKSCEMGLQLRQTFEAAILTQLHPRSQIDIYVQVLQADGGTYAACVNAATLAVLDAGIPMRDFVCACSAGFVDGTALADLSHVEEAAGGPQLALALLPASGQIALLEMDARLHEDHLERVLEAAAQAARDVHTLLDRVVRQHVRE

SEQ ID NO: 29158 - protein, 235 aa, Homo sapiens
  Payload ID: 5684
  Gene Symbol: EXOSC5
  Gene Name: exosome component 5
  Uniprot ID: Q9NQT4
  ENSP ID: ENSP00000221233
MEEETHTDAKIRAENGTGSSPRGPGCSLRHFACEQNLLSRPDGSASFLQGDTSVLAGVYGPAEVKVSKEIFNKATLEVILRPKIGLPGVAEKSRERLIRNTCEAVVLGTLHPRTSITVVLQVVSDAGSLLACCLNAACMALVDAGVPMRALFCGVACALDSDGTLVLDPTSKQEKEARAVLTFALDSVERKLLMSSTKGLYSDTELQQCLAAAQAASQHVFRFYRESLQRRYSKS

SEQ ID NO: 29159 - protein, 197 aa, Homo sapiens
  Payload ID: 5684
  Gene Symbol: EXOSC5
  Gene Name: exosome component 5
  ENSP ID: ENSP00000471002
MEEETHTDAKIRAENGTGSSPRGPGCSLRHFACEQNLLSRPDGSASFLQGVAEKSRERLIRNTCEAVVLGTLHPRTSITVVLQVVSDAGSLLACCLNAACMALVDAGVPMRALFCGVACALDSDGTLVLDPTSKQEKEARAVLTFALDSVERKLLMSSTKGLYSDTELQQCLAAAQAASQHVFRFYRESLQRRYSKS

SEQ ID NO: 29160 - protein, 133 aa, Homo sapiens
  Payload ID: 5684
  Gene Symbol: EXOSC5
  Gene Name: exosome component 5
  ENSP ID: ENSP00000471557
MEEETHTDAKIRAENGTGSSPRGPGCSLRHFACEQNLLSRPDGSASFLQGDTSVLAGVYGPAEVKVSKEIFNKATLEVILRPKIGLPAGVSGWQSGLAFFPLESSIIPAGVAEKSRERLIRNTCEAVVLGTLH

SEQ ID NO: 29161 - protein, 62 aa, Homo sapiens
  Payload ID: 5684
  Gene Symbol: EXOSC5
  Gene Name: exosome component 5
  ENSP ID: ENSP00000472396
GCSLRHFACEQNLLSRPDGSASFLQGDTSVLAGVYGPAEVKVSKEIFNKATLEVILSPALPL

SEQ ID NO: 29162 - protein, 272 aa, Homo sapiens
  Payload ID: 5685
  Gene Symbol: EXOSC6
  Gene Name: exosome component 6
  Uniprot ID: Q5RKV6
  ENSP ID: ENSP00000398597
MPGDHRRIRGPEESQPPQLYAADEEEAPGTRDPTRLRPVYARAGLLSQAKGSAYLEAGGTKVLCAVSGPRQAEGGERGGGPAGAGGEAPAALRGRLLCDFRRAPFAGRRRRAPPGGCEERELALALQEALEPAVRLGRYPRAQLEVSALLLEDGGSALAAALTAAALALADAGVEMYDLVVGCGLSLAPGPAPTWLLDPTRLEEERAAAGLTVALMPVLNQVAGLLGSGEGGLTESWAEAVRLGLEGCQRLYPVLQQSLVRAARRRGAAAQP

SEQ ID NO: 29163 - protein, 291 aa, Homo sapiens [sequence omitted]

SEQ ID NO: 29164 - protein, 37 aa, Homo sapiens
  Payload ID: 5687
  Gene Symbol: EXOSC8
  Gene Name: exosome component 8
  ENSP ID: ENSP00000239893
MAAGFKKRTAVLMEENLVNSEPQLSTSVQLVPQMVLL

SEQ ID NO: 29165 - protein, 276 aa, Homo sapiens
  Payload ID: 5687
  Gene Symbol: EXOSC8
  Gene Name: exosome component 8
  Uniprot ID: Q96B26
  ENSP ID: ENSP00000374354
MAAGFKTVEPLEYYRRFLKENCRPDGRELGEFRTTTVNIGSISTADGSALVKLGNTTVICGVKAEFAAPSTDAPDKGYVVPNVDLPPLCSSRFRSGPPGEEAQVASQFIADVIENSQIIQKEDLCISPGKLVWVLYCDLICLDYDGNILDACTFALLAALKNVQLPEVTINEETALAEVNLKKKSYLNIRTHPVATSFAVFDDTLLIVDPTGEEEHLATGTLTIVMDEEGKLCCLHKPGGSGLTGAKLQDCMSRAVTRHKEVKKLMDEVIKSMKPK

SEQ ID NO: 29166 - protein, 69 aa, Homo sapiens
  Payload ID: 5687
  Gene Symbol: EXOSC8
  Gene Name: exosome component 8
  ENSP ID: ENSP00000419203
VWVLYCDLICLDYDGNILDACTFALLAALKNGGSGLTGAKLQDCMSRAVTRHKEVKKLMDEVIKSMKPK

SEQ ID NO: 29167 - protein, 439 aa, Homo sapiens
  Payload ID: 5688
  Gene Symbol: EXOSC9
  Gene Name: exosome component 9
  Uniprot ID: Q06265
  ENSP ID: ENSP00000243498
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQDAPIILSDSEEEEMIILEPDKNPKKIRTQTTSAKQEKAPSKKPVKRRKKKRAAN

SEQ ID NO: 29168 - protein, 456 aa, Homo sapiens
  Payload ID: 5688
  Gene Symbol: EXOSC9
  Gene Name: exosome component 9
  Uniprot ID: Q06265
  ENSP ID: ENSP00000368984
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQELGFHHVGQTGLEFLTSDAPIILSDSEEEEMIILEPDKNPKKIRTQTTSAKQEKAPSKKPVKRRKKKRAAN

SEQ ID NO: 29169 - protein, 86 aa, Homo sapiens
  Payload ID: 5688
  Gene Symbol: EXOSC9
  Gene Name: exosome component 9
  ENSP ID: ENSP00000421845
MKETPLSNCERRFLLRAIEEKKRLDGRQTYDYRNIRISFGTDYGCCIVELGKTRVLGQVSCELVSPKLNRATEGLANTCRPTFIKS

SEQ ID NO: 29170 - protein, 226 aa, Homo sapiens
  Payload ID: 5688
  Gene Symbol: EXOSC9
  Gene Name: exosome component 9
  ENSP ID: ENSP00000422205
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKYTPEERDPVPLSIHHMPICVSFAFFQQGTYLLVDPNEREERVMDGLLVIAMNKHREICTIQSSGGIMLLKDQVLRCSKIAGVKVAEITELILKALEND

SEQ ID NO: 29171 - protein, 242 aa, Homo sapiens
  Payload ID: 5688
  Gene Symbol: EXOSC9
  Gene Name: exosome component 9
  ENSP ID: ENSP00000423476
MKETPLSNCERRFLLRAIEEKKRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGSEMQ

SEQ ID NO: 29172 - protein, 172 aa, Homo sapiens
  Payload ID: 5688
  Gene Symbol: EXOSC9
  Gene Name: exosome component 9
  ENSP ID: ENSP00000424504
  MOD_RES (1)..(1): Any amino acid
XSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVSVSTPVLWTPGTAQIGEGVENSWGDLEDSEKEDDEGGGDQAIILDGIKMDTGVEVSDIGSQ

SEQ ID NO: 29173 - protein, 423 aa, Homo sapiens
  Payload ID: 5688
  Gene Symbol: EXOSC9
  Gene Name: exosome component 9
  ENSP ID: ENSP00000425782
MNLCLQRLDGRQTYDYRNIRISFGTDYGCCIVELGKTRVLGQVSCELVSPKLNRATEGILFFNLELSQMAAPAFEPGRQSDLLVKLNRLMERCLRNSKCIDTESLCVVAGEKVWQIRVDLHLLNHDGNIIDAASIAAIVALCHFRRPDVSVQGDEVTLYTPEERDPVPLSIHHMPICVSFAFFQQGTYLLVDPNEREERVMDGLLVIAMNKHREICTIQSSGGIMLLKDQVLRCSKIAGVKVAEITELILKALENDQKVRKEGGKFGFAESIANQRITAFKMEKAPIDTSDVEEKAEEIIAEAEPPSEVVSTPVLWTPGTAQIGEGVENSWGDLEDSEKEDDEGGGDQAIILDGIKMDTGVEVSDIGSQDAPIILSDSEEEEMIILEPDKNPKKIRTQTTSAKQEKAPSKKPVKRRKKKRAAN

SEQ ID NO: 29174 - protein, 746 aa, Homo sapiens
  Payload ID: 5689
  Gene Symbol: EXT1
  Gene Name: exostosin glycosyltransferase 1
  Uniprot ID: Q16394
  ENSP ID: ENSP00000367446
MQAKKRYFILLSAGSCLALLFYFGGLQFRASRSHSRREEHSGRNGLHHPSPDHFWPRFPDALRPFVPWDQLENEDSSVHISPRQKRDANSSIYKGKKCRMESCFDFTLCKKNGFKVYVYPQQKGEKIAESYQNILAAIEGSRFYTSDPSQACLFVLSLDTLDRDQLSPQYVHNLRSKVQSLHLWNNGRNHLIFNLYSGTWPDYTEDVGFDIGQAMLAKASISTENFRPNFDVSIPLFSKDHPRTGGERGFLKFNTIPPLRKYMLVFKGKRYLTGIGSDTRNALYHVHNGEDVVLLTTCKHGKDWQKHKDSRCDRDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVLKLLVAAAKSQYCAQIIVLWNCDKPLPAKHRWPATAVPVVVIEGESKVMSSRFLPYDNIITDAVLSLDEDTVLSTTEVDFAFTVWQSFPERIVGYPARSHFWDNSKERWGYTSKWTNDYSMVLTGAAIYHKYYHYLYSHYLPASLKNMVDQLANCEDILMNFLVSAVTKLPPIKVTQKKQYKETMMGQTSRASRWADPDHFAQRQSCMNTFASWFGYMPLIHSQMRLDPVLFKDQVSILRKKYRDIERL

SEQ ID NO: 29175 - protein, 207 aa, Homo sapiens
  Payload ID: 5689
  Gene Symbol: EXT1
  Gene Name: exostosin glycosyltransferase 1
  ENSP ID: ENSP00000400372
  MOD_RES (1)..(1): Any amino acid
XGQAMLAKASISTENFRPNFDVSIPLFSKDHPRTGGERGFLKFNTIPPLRKYMLVFKGKRYLTGIGSDTRNALYHVHNGEDVVLLTTCKHGKDWQKHKDSRCDRDNTEYEKYDYREMLHNATFCLVPRGRRLGSFRFLEALQAACVPVMLSNGWELPFSEVINWNQAAVIGDERLLLQTPISVGLVICYGGKHAERDSFYNQVYSSG

SEQ ID NO: 29176 - protein, 41 aa, Homo sapiens
  Payload ID: 5689
  Gene Symbol: EXT1
  Gene Name: exostosin glycosyltransferase 1
  ENSP ID: ENSP00000407299
MQAKKRYFILLSAGSCLALLFYFGGCLRPCDAQQWMGVAIL

SEQ ID NO: 29177 - protein, 718 aa, Homo sapiens
  Payload ID: 5690
  Gene Symbol: EXT2
  Gene Name: exostosin glycosyltransferase 2
  Uniprot ID: Q93063
  ENSP ID: ENSP00000342656
MCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 29178 - protein, 728 aa, Homo sapiens
  Payload ID: 5690
  Gene Symbol: EXT2
  Gene Name: exostosin glycosyltransferase 2
  Uniprot ID: Q93063
  ENSP ID: ENSP00000351509
MCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQLFMEPARRENWSAANHQMNSLIWPREQWDSQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 29179 - protein, 751 aa, Homo sapiens
  Payload ID: 5690
  Gene Symbol: EXT2
  Gene Name: exostosin glycosyltransferase 2
  Uniprot ID: Q93063
  ENSP ID: ENSP00000379032
MSCASGSGGGLRHPLRCQKPWDEECEEEAVCVIMCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 29180 - protein, 718 aa, Homo sapiens; identical to SEQ ID NO: 29177
  Payload ID: 5690
  Gene Symbol: EXT2
  Gene Name: exostosin glycosyltransferase 2
  Uniprot ID: Q93063
  ENSP ID: ENSP00000431173

SEQ ID NO: 29181 - protein, 49 aa, Homo sapiens
  Payload ID: 5690
  Gene Symbol: EXT2
  Gene Name: exostosin glycosyltransferase 2
  ENSP ID: ENSP00000433827
MCASVKYNIRGPALIPRMKTKHRIYYITLFSIVLLGLIATGMFQFWPHS

SEQ ID NO: 29182 - protein, 112 aa, Homo sapiens
  Payload ID: 5690
  Gene Symbol: EXT2
  Gene Name: exostosin glycosyltransferase 2
  ENSP ID: ENSP00000434716
MCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALK

SEQ ID NO: 29183 - protein, 676 aa, Homo sapiens
  Payload ID: 5691
  Gene Symbol: EXTL1
  Gene Name: exostosin-like glycosyltransferase 1
  Uniprot ID: Q92935
  ENSP ID: ENSP00000363398
MQSWRRRKSLWLALSASWLLLVLLGGFSLLRLALPPRPRPGASQGWPRWLDAELLQSFSQPGELPEDAVSPPQAPHGGSCNWESCFDTSKCRGDGLKVFVYPAVGTISETHRRILASIEGSRFYTFSPAGACLLLLLSLDAQTGECSSMPLQWNRGRNHLVLRLHPAPCPRTFQLGQAMVAEASPTVDSFRPGFDVALPFLPEAHPLRGGAPGQLRQHSPQPGVALLALEEERGGWRTADTGSSACPWDGRCEQDPGPGQTQRQETLPNATFCLISGHRPEAASRFLQALQAGCIPVLLSPRWELPFSEVIDWTKAAIVADERLPLQVLAALQEMSPARVLALRQQTQFLWDAYFSSVEKVIHTTLEVIQDRIFGTSAHPSLLWNSPPGALLALSTFSTSPQDFPFYYLQQGSRPEGRFSALIWVGPPGQPPLKLIQAVAGSQHCAQILVLWSNERPLPSRWPETAVPLTVIDGHRKVSDRFYPYSTIRTDAILSLDARSSLSTSEVDFAFLVWQSFPERMVGFLTSSHFWDEAHGGWGYTAERTNEFSMVLTTAAFYHRYYHTLFTHSLPKALRTLADEAPTCVDVLMNFIVAAVTKLPPIKVPYGKQRQEAAPLAPGGPGPRPKPPAPAPDCINQIAAAFGHMPLLSSRLRLDPVLFKDPVSVQRKKYRSLEKP

SEQ ID NO: 29184 - protein, 330 aa, Homo sapiens
  Payload ID: 5692
  Gene Symbol: EXTL2
  Gene Name: exostosin-like glycosyltransferase 2
  Uniprot ID: Q9UBQ6
  ENSP ID: ENSP00000359131
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGKTSGIFVKPVNMDNLEKETNSGYSGMWHRAEHALQRSYCINKLVNIYDSMPLRYSNIMISQFGFPYANYKRKI

SEQ ID NO: 29185 - protein, 330 aa, Homo sapiens; identical to SEQ ID NO: 29184
  Payload ID: 5692
  Gene Symbol: EXTL2
  Gene Name: exostosin-like glycosyltransferase 2
  Uniprot ID: Q9UBQ6
  ENSP ID: ENSP00000359132

SEQ ID NO: 29186 - protein, 117 aa, Homo sapiens
  Payload ID: 5692
  Gene Symbol: EXTL2
  Gene Name: exostosin-like glycosyltransferase 2
  ENSP ID: ENSP00000392255
MGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANR

SEQ ID NO: 29187 - protein, 266 aa, Homo sapiens
  Payload ID: 5692
  Gene Symbol: EXTL2
  Gene Name: exostosin-like glycosyltransferase 2
  ENSP ID: ENSP00000403363
MRTWNSGGTKCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGK

SEQ ID NO: 29188 - protein, 147 aa, Homo sapiens
  Payload ID: 5692
  Gene Symbol: EXTL2
  Gene Name: exostosin-like glycosyltransferase 2
  ENSP ID: ENSP00000444385
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAIS

SEQ ID NO: 29189 - protein, 919 aa, Homo sapiens
  Payload ID: 5693
  Gene Symbol: EXTL3
  Gene Name: exostosin-like glycosyltransferase 3
  Uniprot ID: O43909
  ENSP ID: ENSP00000220562
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 29190 - protein, 75 aa, Homo sapiens
  Payload ID: 5693
  Gene Symbol: EXTL3
  Gene Name: exostosin-like glycosyltransferase 3
  ENSP ID: ENSP00000428352
  MOD_RES (1)..(1): Any amino acid
XLDPLVKQAFQATARANVYVTENADIACLYVILVGEMQEPVVLRPAELEKQLYSLPHWRTDGHNHVIINLSRGPY

SEQ ID NO: 29191 - protein, 535 aa, Homo sapiens
  Payload ID: 5693
  Gene Symbol: EXTL3
  Gene Name: exostosin-like glycosyltransferase 3
  ENSP ID: ENSP00000428691
MLHKSEEGRVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 29192 - protein, 201 aa, Homo sapiens
  Payload ID: 5693
  Gene Symbol: EXTL3
  Gene Name: exostosin-like glycosyltransferase 3
  ENSP ID: ENSP00000429627
  MOD_RES (1)..(1): Any amino acid
XLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKVTSRWTFRCPGCPQALSHDDSHFHERHKCINFFVKVYGYMPLLYTQFRVDSVLFKTRLPH

SEQ ID NO: 29193 - protein, 118 aa, Homo sapiens
  Payload ID: 5693
  Gene Symbol: EXTL3
  Gene Name: exostosin-like glycosyltransferase 3
  ENSP ID: ENSP00000430652
MFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSH

SEQ ID NO: 29194 - protein, 137 aa, Homo sapiens
  Payload ID: 5693
  Gene Symbol: EXTL3
  Gene Name: exostosin-like glycosyltransferase 3
  ENSP ID: ENSP00000431013
MGENARHFDRRNEGVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFL

SEQ ID NO: 29195 - protein, 1071 aa, Homo sapiens
  Payload ID: 5694
  Gene Symbol: XPO1
  Gene Name: exportin 1
  Uniprot ID: O14980
  ENSP ID: ENSP00000384863
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 29196 - protein, 1071 aa, Homo sapiens; identical to SEQ ID NO: 29195
  Payload ID: 5694
  Gene Symbol: XPO1
  Gene Name: exportin 1
  Uniprot ID: O14980
  ENSP ID: ENSP00000385559

SEQ ID NO: 29197 - protein, 1071 aa, Homo sapiens; identical to SEQ ID NO: 29195
  Payload ID: 5694
  Gene Symbol: XPO1
  Gene Name: exportin 1
  Uniprot ID: O14980
  ENSP ID: ENSP00000385942

SEQ ID NO: 29198 - protein, 72 aa, Homo sapiens
  Payload ID: 5694
  Gene Symbol: XPO1
  Gene Name: exportin 1
  ENSP ID: ENSP00000388927
RMAQEVLTHLKEHPDAWTRVDTILEFSQNMNTKYYGLQILENVIKTRWKILPRNQCEDTETRMAQTLANFYQ

SEQ ID NO: 29199 - protein, 59 aa, Homo sapiens
  Payload ID: 5694
  Gene Symbol: XPO1
  Gene Name: exportin 1
  ENSP ID: ENSP00000390843
MPAIMTMLADHAARQLLDFSQKLDINLLDNVVNCLYHGEGAQQRMAQEVLTHLKEHPDA

SEQ ID NO: 29200 - protein, 100 aa, Homo sapiens
  Payload ID: 5694
  Gene Symbol: XPO1
  Gene Name: exportin 1
  ENSP ID: ENSP00000393484
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCE

SEQ ID NO: 29201 - protein, 94 aa, Homo sapiens
  Payload ID: 5694
  Gene Symbol: XPO1
  Gene Name: exportin 1
  ENSP ID: ENSP00000394951
MPAIMTMLADHAARQLLDFSQKLDINLLDNVVNCLYHGEGAQQRMAQEVLTHLKEHPDAWTRVDTILEFSQNMNTKYYGLQILENVIKTRWKIL

SEQ ID NO: 29202 - protein, 132 aa, Homo sapiens
  Payload ID: 5694
  Gene Symbol: XPO1
  Gene Name: exportin 1
  ENSP ID: ENSP00000406428
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNM

SEQ ID NO: 29203 - protein, 62 aa, Homo sapiens
  Payload ID: 5694
  Gene Symbol: XPO1
  Gene Name: exportin 1
  ENSP ID: ENSP00000406819
MPAIMTMLADHAARQLLDFSQKLDINLLDNVVNCLYHGEGAQQRMAQEVLTHLKEHPDAWTR

SEQ ID NO: 29204 - protein, 82 aa, Homo sapiens
  Payload ID: 5694
  Gene Symbol: XPO1
  Gene Name: exportin 1
  ENSP ID: ENSP00000407170
MPAIMTMLADHAARQLLDFSQKLDINLLDNVVNCLYHGEGAQQRMAQEVLTHLKEHPDAWTRVDTILEFSQNMNTKVSKWWF

SEQ ID NO: 29205 - protein, 95 aa, Homo sapiens
  Payload ID: 5694
  Gene Symbol: XPO1
  Gene Name: exportin 1
  ENSP ID: ENSP00000408190
MPAIMTMLADHAARQLLDFSQKLDINLLDNVVNCLYHGEGAQQRMAQEVLTHLKEHPDAWTRVDTILEFSQNMNTKYYGLQILENVIKTRWKILP

SEQ ID NO: 29206 - protein, 179 aa, Homo sapiens
  Payload ID: 5694
  Gene Symbol: XPO1
  Gene Name: exportin 1
  ENSP ID: ENSP00000413853
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVF

SEQ ID NO: 29207 - protein, 1151 aa, Homo sapiens
  Payload ID: 5695
  Gene Symbol: XPO4
  Gene Name: exportin 4
  Uniprot ID: Q9C0E2
  ENSP ID: ENSP00000255305
MMAAALGPPEVIAQLENAAKVLMAPPSMVNNEQRQHAEHIFLSFRKSKSPFAVCKHILETSKVDYVLFQAATAIMEAVVREWILLEKGSIESLRTFLLTYVLQRPNLQKYVREQILLAVAVIVKRGSLDKSIDCKSIFHEVSQLISSGNPTVQTLACSILTALLSEFSSSSKTSNIGLSMEFHGNCKRVFQEEDLRQIFMLTVEVLQEFSRRENLNAQMSSVFQRYLALANQVLSWNFLPPNLGRHYIAMFESSQNVLLKPTESWRETLLDSRVMELFFTVHRKIREDSDMAQDSLQCLAQLASLHGPIFPDEGSQVDYLAHFIEGLLNTINGIEIEDSEAVGISSIISNLITVFPRNVLTAIPSELFSSFVNCLTHLTCSFGRSAALEEVLDKDDMVYMEAYDKLLESWLTLVQDDKHFHKGFFTQHAVQVFNSYIQCHLAAPDGTRNLTANGVASREEEEISELQEDDRDQFSDQLASVGMLGRIAAEHCIPLLTSLLEERVTRLHGQLQRHQQQLLASPGSSTVDNKMLDDLYEDIHWLILVTGYLLADDTQGETPLIPPEIMEYSIKHSSEVDINTTLQILGSPGEKASSIPGYNRTDSVIRLLSAILRVSEVESRAIRADLTHLLSPQMGKDIVWFLKRWAKTYLLVDEKLYDQISLPFSTAFGADTEGSQWIIGYLLQKVISNLSVWSSEQDLANDTVQLLVTLVERRERANLVIQCENWWNLAKQFASRSPPLNFLSSPVQRTLMKALVLGGFAHMDTETKQQYWTEVLQPLQQRFLRVINQENFQQMCQQEEVKQEITATLEALCGIAEATQIDNVAILFNFLMDFLTNCIGLMEVYKNTPETVNLIIEVFVEVAHKQICYLGESKAMNLYEACLTLLQVYSKNNLGRQRIDVTAEEEQYQDLLLIMELLTNLLSKEFIDFSDTDEVFRGHEPGQAANRSVSAADVVLYGVNLILPLMSQDLLKFPTLCNQYYKLITFICEIFPEKIPQLPEDLFKSLMYSLELGMTSMSSEVCQLCLEALTPLAEQCAKAQETDSPLFLATRHFLKLVFDMLVLQKHNTEMTTAAGEAFYTLVCLHQAEYSELVETLLSSQQDPVIYQRLADAFNKLTASSTPPTLDRKQKMAFLKSLEEFMANVGGLLCVK

SEQ ID NO: 29208 - protein, 1151 aa, Homo sapiens [sequence omitted]

SEQ ID NO: 29209 - protein, 1204 aa, Homo sapiens
  Payload ID: 5696
  Gene Symbol: XPO5
  Gene Name: exportin 5
  Uniprot ID: Q9HAV4
  ENSP ID: ENSP00000265351
MAMDQVNALCEQLVKAVTVMMDPNSTQRYRLEALKFCEEFKEKCPICVPCGLRLAEKTQVAIVRHFGLQILEHVVKFRWNGMSRLEKVYLKNSVMELIANGTLNILEEENHIKDALSRIVVEMIKREWPQHWPDMLIELDTLSKQGETQTELVMFILLRLAEDVVTFQTLPPQRRRDIQQTLTQNMERIFSFLLNTLQENVNKYQQVKTDTSQESKAQANCRVGVAALNTLAGYIDWVSMSHITAENCKLLEILCLLLNEQELQLGAAECLLIAVSRKGKLEDRKPLMVLFGDVAMHYILSAAQTADGGGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKMGFPSKTDSPSCEYSRFDFDSDEDFNAFFNSSRAQQGEVMRLACRLDPKTSFQMAGEWLKYQLSTFLDAGSVNSCSAVGTGEGSLCSVFSPSFVQWEAMTLFLESVITQMFRTLNREEIPVNDGIELLQMVLNFDTKDPLILSCVLTNVSALFPFVTYRPEFLPQVFSKLFSSVTFETVEESKAPRTRAVRNVRRHACSSIIKMCRDYPQLVLPNFDMLYNHVKQLLSNELLLTQMEKCALMEALVLISNQFKNYERQKVFLEELMAPVASIWLSQDMHRVLSDVDAFIAYVGTDQKSCDPGLEDPCGLNRARMSFCVYSILGVVKRTCWPTDLEEAKAGGFVVGYTSSGNPIFRNPCTEQILKLLDNLLALIRTHNTLYAPEMLAKMAEPFTKALDMLDAEKSAILGLPQPLLELNDSPVFKTVLERMQRFFSTLYENCFHILGKAGPSMQQDFYTVEDLATQLLSSAFVNLNNIPDYRLRPMLRVFVKPLVLFCPPEHYEALVSPILGPLFTYLHMRLSQKWQVINQRSLLCGEDEAADENPESQEMLEEQLVRMLTREVMDLITVCCVSKKGADHSSAPPADGDDEEMMATEVTPSAMAELTDLGKCLMKHEDVCTALLITAFNSLAWKDTLSCQRTTSQLCWPLLKQVLSGTLLADAVTWLFTSVLKGLQMHGQHDGCMASLVHLAFQIYEALRPRYLEIRAVMEQIPEIQKDSLDQFDCKLLNPSLQKVADKRRKDQFKRLIAGCIGKPLGEQFRKEVHIKNLPSLFKKTKPMLETEVLDNDGGGLATIFEP

SEQ ID NO: 29210 - protein, 76 aa, Homo sapiens
  Payload ID: 5696
  Gene Symbol: XPO5
  Gene Name: exportin 5
  ENSP ID: ENSP00000381779
MAMDQVNALCEQLVKAVTVMMDPNSTQRYRLEALKFCEEFKEKCPICVPCGLRLAEKTQVAIVRHFGLQILEHVVK

SEQ ID NO: 29211 - protein, 24 aa, Homo sapiens
  Payload ID: 5696
  Gene Symbol: XPO5
  Gene Name: exportin 5
  ENSP ID: ENSP00000381816
  MOD_RES (1)..(1): Any amino acid
XVGTDQKSCDPGLEDPCGLNRARS

SEQ ID NO: 29212 - protein, 253 aa, Homo sapiens
  Payload ID: 5696
  Gene Symbol: XPO5
  Gene Name: exportin 5
  ENSP ID: ENSP00000387384
  MOD_RES (1)..(1): Any amino acid
XPLVLFCPPEHYEALVSPILGPLFTYLHMRLSQKWQVINQRSLLCGEDEAADENPESQEMLEEQLVRMLTREVMDLITVCCVSKKGADHSSAPPADGDGWSLTFYSLITDEEMMATEVTPSAMAELTDLGKCLMKHEDVCTALLITAFNSLAWKDTLSCQRTTSQLCWPLLKQVLSGTLLADAVTWLFTSVLKGLQMHGQHDGCMASLVHLAFQIYEALRPRYLEIRAVMEQIPEIQKDSLDQFDCKLLNPSL

SEQ ID NO: 29213 - protein, 107 aa, Homo sapiens
  Payload ID: 5696
  Gene Symbol: XPO5
  Gene Name: exportin 5
  ENSP ID: ENSP00000424196
GGLVEKHYVFLKRLCQVLCALGNQLCALLGADSDVETPSNFGKYLESFLAFTTHPSQFLRSSTQMTWGALFRHEILSRDPLLLAIIPKYLRASMTNLVKPPEHNKER

SEQ ID NO: 29214 - protein, 60 aa, Homo sapiens
  Payload ID: 5696
  Gene Symbol: XPO5
  Gene Name: exportin 5
  ENSP ID: ENSP00000426185
  MOD_RES (1)..(1): Any amino acid
XLSQKWQVINQRSLLCGEDEAADENPESQEMLEEQLRFAVFQRRVLTTVVLPQQMETMKK

SEQ ID NO: 29215 - protein, 1125 aa, Homo sapiens
  Payload ID: 5697
  Gene Symbol: XPO6
  Gene Name: exportin 6
  Uniprot ID: Q96QU8
  ENSP ID: ENSP00000302790
MASEEASLRALESLMTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 29216 - protein, 153 aa, Homo sapiens
  Payload ID: 5697
  Gene Symbol: XPO6
  Gene Name: exportin 6
  ENSP ID: ENSP00000454586
IHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRVRRERGRAKRRAEWARKPGTCAARRGHIEASGRGLCPPCSLAAAHEMPADLVL

SEQ ID NO: 29217 - protein, 161 aa, Homo sapiens
  Payload ID: 5697
  Gene Symbol: XPO6
  Gene Name: exportin 6
  ENSP ID: ENSP00000455310
  MOD_RES (1)..(1): Any amino acid
XEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVSKTSCCYLRATYWSHWPPPCGPSF

SEQ ID NO: 29218 - protein, 142 aa, Homo sapiens
  Payload ID: 5697
  Gene Symbol: XPO6
  Gene Name: exportin 6
  ENSP ID: ENSP00000456066
MTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEE

SEQ ID NO: 29219 - protein, 17 aa, Homo sapiens
  Payload ID: 5697
  Gene Symbol: XPO6
  Gene Name: exportin 6
  ENSP ID: ENSP00000456273
MTEFFHDCTTNERKREI

SEQ ID NO: 29220 - protein, 132 aa, Homo sapiens
  Payload ID: 5697
  Gene Symbol: XPO6
  Gene Name: exportin 6
  ENSP ID: ENSP00000456422
SFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRNVHRLVNDLRYYRLCNDSLPPGTVKL

SEQ ID NO: 29221 - protein, 1111 aa, Homo sapiens
  Payload ID: 5697
  Gene Symbol: XPO6
  Gene Name: exportin 6
  Uniprot ID: Q96QU8
  ENSP ID: ENSP00000457341
MTEFFHDCTTNERKREIEELLNNFAQQIGAWRFCLYFLSSTRNDYVMMYSLTVFENLINKMWLGVPSQDKMEIRSCLPKLLLAHHKTLPYFIRNKLCKVIVDIGRQDWPMFYHDFFTNILQLIQSPVTTPLGLIMLKTTSEELACPREDLSVARKEELRKLLLDQVQTVLGLLTGILETVWDKHSVTAATPPPSPTSGESGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCLDIWTLFLDYLTSKIKSRLGDKEAVLNRYEDALVLLLTEVLNRIQFRYNQAQLEELDDETLDDDQQTEWQRYLRQSLEVVAKVMELLPTHAFSTLFPVLQDNLEVYLGLQQFIVTSGSGHRLNITAENDCRRLHCSLRDLSSLLQAVGRLAEYFIGDVFAARFNDALTVVERLVKVTLYGSQIKLYNIETAVPSVLKPDLIDVHAQSLAALQAYSHWLAQYCSEVHRQNTQQFVTLISTTMDAITPLISTKVQDKLLLSACHLLVSLATTVRPVFLISIPAVQKVFNRITDASALRLVDKAQVLVCRALSNILLLPWPNLPENEQQWPVRSINHASLISALSRDYRNLKPSAVAPQRKMPLDDTKLIIHQTLSVLEDIVENISGESTKSRQICYQSLQESVQVSLALFPAFIHQSDVTDEMLSFFLTLFRGLRVQMGVPFTEQIIQTFLNMFTREQLAESILHEGSTGCRVVEKFLKILQVVVQEPGQVFKPFLPSIIALCMEQVYPIIAERPSPDVKAELFELLFRTLHHNWRYFFKSTVLASVQRGIAEEQMENEPQFSAIMQAFGQSFLQPDIHLFKQNLFYLETLNTKQKLYHKKIFRTAMLFQFVNVLLQVLVHKSHDLLQEEIGIAIYNMASVDFDGFFAAFLPEFLTSCDGVDANQKSVLGRNFKMDRDLPSFTQNVHRLVNDLRYYRLCNDSLPPGTVKL

SEQ ID NO: 29222 - protein, 21 aa, Homo sapiens
  Payload ID: 5697
  Gene Symbol: XPO6
  Gene Name: exportin 6
  ENSP ID: ENSP00000457742
MMYSLTVFENLINKMWLGVPS

SEQ ID NO: 29223 - protein, 135 aa, Homo sapiens
  Payload ID: 5697
  Gene Symbol: XPO6
  Gene Name: exportin 6
  ENSP ID: ENSP00000458314
  MOD_RES (1)..(1): Any amino acid
XALSRDYRNLKPSAVAPQRKMPLDDTKLIIHQTLSVLEDIVENISGESTKSRQICYQSLQESVQVSLALFPAFIHQSGLRVQMGVPFTEQIIQTFLNMFTREQLAESILHEGSTGCRVVEKFLKILQVVVQEPGQ

SEQ ID NO: 29224 - protein, 19 aa, Homo sapiens
  Payload ID: 5697
  Gene Symbol: XPO6
  Gene Name: exportin 6
  ENSP ID: ENSP00000459591
NAHTVKSRLEELDERWLME

SEQ ID NO: 29225 - protein, 255 aa, Homo sapiens
  Payload ID: 5697
  Gene Symbol: XPO6
  Gene Name: exportin 6
  ENSP ID: ENSP00000459736
  MOD_RES (1)..(1): Any amino acid
XSPVTTPLGLIMLKTTSEELACPREDLSVARKEELRKLLLDQVQTVLGLLTGDLLSNLLQSPSSAKLLNQPIPILDVESEYICSLALECLAHLFSWIPLSASITPSLLTTIFHFARFGCDIRARKMASVNGSSQNCVSGQERGRLGVLAMSCINELMSKNCVPMEFEEYLLRMFQQTFYLLQKITKDNNAHTVKSRLEELDESYIEKFTDFLRLFVSVHLRRIESYSQFPVVEFLTLLFKYTFHQPTHEGYFSCL

SEQ ID NO: 29226 - protein, 1087 aa, Homo sapiens
  Payload ID: 5698
  Gene Symbol: XPO7
  Gene Name: exportin 7
  Uniprot ID: Q9UIA9
  ENSP ID: ENSP00000252512
MADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 29227 - protein, 1088 aa, Homo sapiens
  Payload ID: 5698
  Gene Symbol: XPO7
  Gene Name: exportin 7
  ENSP ID: ENSP00000410249
MRDPGRKSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 29228 - protein, 190 aa, Homo sapiens
  Payload ID: 5698
  Gene Symbol: XPO7
  Gene Name: exportin 7
  ENSP ID: ENSP00000429290
  MOD_RES (1)..(1): Any amino acid
XEWSKMADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQVSATAFLIEADTTHPLTKHRK

SEQ ID NO: 29229 - protein, 237 aa, Homo sapiens
  Payload ID: 5698
  Gene Symbol: XPO7
  Gene Name: exportin 7
  ENSP ID: ENSP00000429317
MLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTAL

SEQ ID NO: 29230 - protein, 962 aa, Homo sapiens
  Payload ID: 5699
  Gene Symbol: XPOT
  Gene Name: exportin, tRNA
  Uniprot ID: O43592
  ENSP ID: ENSP00000327821
MDEQALLGLNPNADSDFRQRALAYFEQLKISPDAWQVCAEALAQRTYSDDHVKFFCFQVLEHQVKYKYSELTTVQQQLIRETLISWLQAQMLNPQPEKTFIRNKAAQVFALLFVTEYLTKWPKFFFDILSVVDLNPRGVDLYLRILMAIDSELVDRDVVHTSEEARRNTLIKDTMREQCIPNLVESWYQILQNYQFTNSEVTCQCLEVVGAYVSWIDLSLIANDRFINMLLGHMSIEVLREEACDCLFEVVNKGMDPVDKMKLVESLCQVLQSAGFFSIDQEEDVDFLARFSKLVNGMGQSLIVSWSKLIKNGDIKNAQEALQAIETKVALMLQLLIHEDDDISSNIIGFCYDYLHILKQLTVLSDQQKANVEAIMLAVMKKLTYDEEYNFENEGEDEAMFVEYRKQLKLLLDRLAQVSPELLLASVRRVFSSTLQNWQTTRFMEVEVAIRLLYMLAEALPVSHGAHFSGDVSKASALQDMMRTLVTSGVSSYQHTSVTLEFFETVVRYEKFFTVEPQHIPCVLMAFLDHRGLRHSSAKVRSRTAYLFSRFVKSLNKQMNPFIEDILNRIQDLLELSPPENGHQSLLSSDDQLFIYETAGVLIVNSEYPAERKQALMRNLLTPLMEKFKILLEKLMLAQDEERQASLADCLNHAVGFASRTSKAFSNKQTVKQCGCSEVYLDCLQTFLPALSCPLQKDILRSGVRTFLHRMIICLEEEVLPFIPSASEHMLKDCEAKDLQEFIPLINQITAKFKIQVSPFLQQMFMPLLHAIFEVLLRPAEENDQSAALEKQMLRRSYFAFLQTVTGSGMSEVIANQGAENVERVLVTVIQGAVEYPDPIAQKTCFIILSKLVELWGGKDGPVGFADFVYKHIVPACFLAPLKQTFDLADAQTVLALSECAVTLKTIHLKRGPECVQYLQQEYLPSLQVAPEIIQEFCQALQQPDAKVFKNYLKVFFQRAKP

SEQ ID NO: 29231 - protein, 201 aa, Homo sapiens
  Payload ID: 5699
  Gene Symbol: XPOT
  Gene Name: exportin, tRNA
  ENSP ID: ENSP00000383722
MDEQALLGLNPNADSDFRQRALAYFEQLKISPDAWQVCAEALAQRTYSDDHVKFFCFQVLEHQVKYKYSELTTVQQQLIRETLISWLQAQMLNPQPEKTFIRNKAAQVFALLFVTEYLTKWPKFFFDILSVVDLNPRGVDLYLRILMAIDSELVDRDVVHTSEEARRNTLIKDTMREQCIPNLVESWYQILQNYQFTNSEV

SEQ ID NO: 29232 - protein, 60 aa, Homo sapiens
  Payload ID: 5699
  Gene Symbol: XPOT
  Gene Name: exportin, tRNA
  ENSP ID: ENSP00000441376
MDEQALLGLNPNADSDFRQRALAYFEQLKISPDAWQVCAEALAQRTYSDDHVKFFCFQVL

SEQ ID NO: 29233 - protein, 63 aa, Homo sapiens
  Payload ID: 5699
  Gene Symbol: XPOT
  Gene Name: exportin, tRNA
  ENSP ID: ENSP00000444345
VFSSTLQNWQTTRFMEVEVAIRLLYMLAEALPVSHGAHFSAGNIRSQFLSAYICDIGVLRNCC

SEQ ID NO: 29234 - protein, 1114 aa, Homo sapiens
  Payload ID: 5700
  Gene Symbol: ESYT1
  Gene Name: extended synaptotagmin-like protein 1
  Uniprot ID: Q9BSJ8
  ENSP ID: ENSP00000267113
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPMVTSELYPPQLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 29235 - protein, 1104 aa, Homo sapiens
  Payload ID: 5700
  Gene Symbol: ESYT1
  Gene Name: extended synaptotagmin-like protein 1
  Uniprot ID: Q9BSJ8
  ENSP ID: ENSP00000377612
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 29236 - protein, 88 aa, Homo sapiens
  Payload ID: 5700
  Gene Symbol: ESYT1
  Gene Name: extended synaptotagmin-like protein 1
  ENSP ID: ENSP00000447756
MSHRELPAWVSFPDVEKAEWLNKIVAQVWPFLGQYMEKLLAETVAPAVRGSNPHLQTFTFTRVELGEKPLRIIGVKVHPGQRKEQILL

SEQ ID NO: 29237 - protein, 893 aa, Homo sapiens
  Payload ID: 5701
  Gene Symbol: ESYT2
  Gene Name: extended synaptotagmin-like protein 2
  Uniprot ID: A0FGR8
  ENSP ID: ENSP00000251527
MTPPSRAEAGVRRSRVPSEGRWRGAEPPGISASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 29238 - protein, 884 aa, Homo sapiens
  Payload ID: 5701
  Gene Symbol: ESYT2
  Gene Name: extended synaptotagmin-like protein 2
  ENSP ID: ENSP00000275418
SASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSNPLEFNPDVLKKTAVQRALKSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 29239 - protein, 921 aa, Homo sapiens
  Payload ID: 5701
  Gene Symbol: ESYT2
  Gene Name: extended synaptotagmin-like protein 2
  ENSP ID: ENSP00000481296
MTANRDAALSSHRHPGCAQRPRTPTFASSSQRRSAFGFDDGNFPGLGERSHAPGSRLGARRRAKTARGLRGHRQRGAGAGLSRPGSARAPSPPRPGAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 29240 - protein, 310 aa, Homo sapiens
  Payload ID: 5702
  Gene Symbol: ESYT3
  Gene Name: extended synaptotagmin-like protein 3
  ENSP ID: ENSP00000289135
MRAEEPCAPGAPSALGAQRTPGPELRLSSQLLPELCTFVVRVLFYLGPVYLAGYLGLSITWLLLGALLWMWWRRNRRGKLGRLAAAFEFLDNEREFISRELRGQHLPAWIHFPDVERVEWANKIISQTWPYLSMIMESKFREKLEPKIREKSIHLRTFTFTKLYFGQKCPRVNGVKAHTNTCNRRRVTVDLQICYIGDCEISVELQKIQAGVNGIQLQGTLRVILEPLLVDKPFVGAVTVFFLQKPHLQINWTGLTNLLDAPGINDVSDSLLEDLIATHLVLPNRVTVPVKKGLDLTNLRFPLPCVSTQY

SEQ ID NO: 29241 - protein, 886 aa, Homo sapiens
  Payload ID: 5702
  Gene Symbol: ESYT3
  Gene Name: extended synaptotagmin-like protein 3
  Uniprot ID: A0FGR9
  ENSP ID: ENSP00000374218
MRAEEPCAPGAPSALGAQRTPGPELRLSSQLLPELCTFVVRVLFYLGPVYLAGYLGLSITWLLLGALLWMWWRRNRRGKLGRLAAAFEFLDNEREFISRELRGQHLPAWIHFPDVERVEWANKIISQTWPYLSMIMESKFREKLEPKIREKSIHLRTFTFTKLYFGQKCPRVNGVKAHTNTCNRRRVTVDLQICYIGDCEISVELQKIQAGVNGIQLQGTLRVILEPLLVDKPFVGAVTVFFLQKPHLQINWTGLTNLLDAPGINDVSDSLLEDLIATHLVLPNRVTVPVKKGLDLTNLRFPLPCGVIRVHLLEAEQLAQKDNFLGLRGKSDPYAKVSIGLQHFRSRTIYRNLNPTWNEVFEFMVYEVPGQDLEVDLYDEDTDRDDFLGSLQICLGDVMTNRVVDEWFVLNDTTSGRLHLRLEWLSLLTDQEVLTEDHGGLSTAILVVFLESACNLPRNPFDYLNGEYRAKKLSRFARNKVSKDPSSYVKLSVGKKTHTSKTCPHNKDPVWSQVFSFFVHNVATERLHLKVLDDDQECALGMLEVPLCQILPYADLTLEQRFQLDHSGLDSLISMRLVLRFLQVEERELGSPYTGPEALKKGPLLIKKVATNQGPKAQPQEEGPTDLPCPPDPASDTKDVSRSTTTTTSATTVATEPTSQETGPEPKGKDSAKRFCEPIGEKKSPATIFLTVPGPHSPGPIKSPRPMKCPASPFAWPPKRLAPSMSSLNSLASSCFDLADISLNIEGGDLRRRQLGEIQLTVRYVCLRRCLSVLINGCRNLTPCTSSGADPYVRVYLLPERKWACRKKTSVKRKTLEPLFDETFEFFVPMEEVKKRSLDVAVKNSRPLGSHRRKELGKVLIDLSKEDLIKGFSQWYELTPNGQPRS

SEQ ID NO: 29242 - protein, 501 aa, Homo sapiens
  Payload ID: 5702
  Gene Symbol: ESYT3
  Gene Name: extended synaptotagmin-like protein 3
  Uniprot ID: A0FGR9
  ENSP ID: ENSP00000417388
MRAEEPCAPGAPSALGAQRTPGPELRLSSQLLPELCTFVVRVLFYLGPVYLAGYLGLSITWLLLGALLWMWWRRNRRGKLGRLAAAFEFLDNEREFISRELRGQHLPAWIHFPDVERVEWANKIISQTWPYLSMIMESKFREKLEPKIREKSIHLRTFTFTKLYFGQKCPRVNGVKAHTNTCNRRRVTVDLQICYIGDCEISVELQKIQAGVNGIQLQGTLRVILEPLLVDKPFVGAVTVFFLQKPHLQINWTGLTNLLDAPGINDVSDSLLEDLIATHLVLPNRVTVPVKKGLDLTNLRFPLPCGVIRVHLLEAEQLAQKDNFLGLRGKSDPYAKVSIGLQHFRSRTIYRNLNPTWNEVFEFMVYEVPGQDLEVDLYDEDTDRDDFLGSLQICLGDVMTNRVVDEWFVLNDTTSGRLHLRLEWLSLLTDQEVLTEDHGGLSTAILVVFLESACNLPRNPFDYLNGEYRAKKLSRFARVKQGQQRPFFLCQTICRQEDTYK

SEQ ID NO: 29243 - protein, 2120 aa, Homo sapiens
  Payload ID: 5703
  Gene Symbol: ESPL1
  Gene Name: extra spindle pole bodies like 1, separase
  Uniprot ID: Q14674
  ENSP ID: ENSP00000257934
MRSFKRVNFGTLLSSQKEAEELLPALKEFLSNPPAGFPSSRSDAERRQACDAILRACNQQLTAKLACPRHLGSLLELAELACDGYLVSTPQRPPLYLERILFVLLRNAAAQGSPEATLRLAQPLHACLVQCSREAAPQDYEAVARGSFSLLWKGAEALLERRAAFAARLKALSFLVLLEDESTPCEVPHFASPTACRAVAAHQLFDASGHGLNEADADFLDDLLSRHVIRALVGERGSSSGLLSPQRALCLLELTLEHCRRFCWSRHHDKAISAVEKAHSYLRNTNLAPSLQLCQLGVKLLQVGEEGPQAVAKLLIKASAVLSKSMEAPSPPLRALYESCQFFLSGLERGTKRRYRLDAILSLFAFLGGYCSLLQQLRDDGVYGGSSKQQQSFLQMYFQGLHLYTVVVYDFAQGCQIVDLADLTQLVDSCKSTVVWMLEALEGLSGQELTDHMGMTASYTSNLAYSFYSHKLYAEACAISEPLCQHLGLVKPGTYPEVPPEKLHRCFRLQVESLKKLGKQAQGCKMVILWLAALQPCSPEHMAEPVTFWVRVKMDAARAGDKELQLKTLRDSLSGWDPETLALLLREELQAYKAVRADTGQERFNIICDLLELSPEETPAGAWARATHLVELAQVLCYHDFTQQTNCSALDAIREALQLLDSVRPEAQARDQLLDDKAQALLWLYICTLEAKMQEGIERDRRAQAPGNLEEFEVNDLNYEDKLQEDRFLYSNIAFNLAADAAQSKCLDQALALWKELLTKGQAPAVRCLQQTAASLQILAALYQLVAKPMQALEVLLLLRIVSERLKDHSKAAGSSCHITQLLLTLGCPSYAQLHLEEAASSLKHLDQTTDTYLLLSLTCDLLRSQLYWTHQKVTKGVSLLLSVLRDPALQKSSKAWYLLRVQVLQLVAAYLSLPSNNLSHSLWEQLCAQGWQTPEIALIDSHKLLRSIILLLMGSDILSTQKAAVETSFLDYGENLVQKWQVLSEVLSCSEKLVCHLGRLGSVSEAKAFCLEALKLTTKLQIPRQCALFLVLKGELELARNDIDLCQSDLQQVLFLLESCTEFGGVTQHLDSVKKVHLQKGKQQAQVPCPPQLPEEELFLRGPALELVATVAKEPGPIAPSTNSSPVLKTKPQPIPNFLSHSPTCDCSLCASPVLTAVCLRWVLVTAGVRLAMGHQAQGLDLLQVVLKGCPEAAERLTQALQASLNHKTPPSLVPSLLDEILAQAYTLLALEGLNQPSNESLQKVLQSGLKFVAARIPHLEPWRASLLLIWALTKLGGLSCCTTQLFASSWGWQPPLIKSVPGSEPSKTQGQKRSGRGRQKLASAPLRLNNTSQKGLEGRGLPCTPKPPDRIRQAGPHVPFTVFEEVCPTESKPEVPQAPRVQQRVQTRLKVNFSDDSDLEDPVSAEAWLAEEPKRRGTASRGRGRARKGLSLKTDAVVAPGSAPGNPGLNGRSRRAKKVASRHCEERRPQRASDQARPGPEIMRTIPEEELTDNWRKMSFEILRGSDGEDSASGGKTPAPGPEAASGEWELLRLDSSKKKLPSPCPDKESDKDLGPRLRLPSAPVATGLSTLDSICDSLSVAFRGISHCPPSGLYAHLCRFLALCLGHRDPYATAFLVTESVSITCRHQLLTHLHRQLSKAQKHRGSLEIADQLQGLSLQEMPGDVPLARIQRLFSFRALESGHFPQPEKESFQERLALIPSGVTVCVLALATLQPGTVGNTLLLTRLEKDSPPVSVQIPTGQNKLHLRSVLNEFDAIQKAQKENSSCTDKREWWTGRLALDHRMEVLIASLEKSVLGCWKGLLLPSSEEPGPAQEASRLQELLQDCGWKYPDRTLLKIMLSGAGALTPQDIQALAYGLCPTQPERAQELLNEAVGRLQGLTVPSNSHLVLVLDKDLQKLPWESMPSLQALPVTRLPSFRFLLSYSIIKEYGASPVLSQGVDPRSTFYVLNPHNNLSSTEEQFRANFSSEAGWRGVVGEVPRPEQVQEALTKHDLYIYAGHGAGARFLDGQAVLRLSCRAVALLFGCSSAALAVRGNLEGAGIVLKYIMAGCPLFLGNLWDVTDRDIDRYTEALLQGWLGAGPGAPLLYYVNQARQAPRLKYLIGAAPIAYGLPVSLR

SEQ ID NO: 29244 - protein, 49 aa, Homo sapiens
  Payload ID: 5703
  Gene Symbol: ESPL1
  Gene Name: extra spindle pole bodies like 1, separase
  ENSP ID: ENSP00000447054
MRSFKRVNFGTLLSSQKEAEELLPALKVGVLPGSGYTWLSKLSCFVFAF

SEQ ID NO: 29245 - protein, 2120 aa, Homo sapiens; identical to SEQ ID NO: 29243
  Payload ID: 5703
  Gene Symbol: ESPL1
  Gene Name: extra spindle pole bodies like 1, separase
  Uniprot ID: Q14674
  ENSP ID: ENSP00000449831

SEQ ID NO: 29246 - protein, 207 aa, Homo sapiens
  Payload ID: 5703
  Gene Symbol: ESPL1
  Gene Name: extra spindle pole bodies like 1, separase
  ENSP ID: ENSP00000456450
MRSFKRVNFGTLLSSQKEAEELLPALKEFLSNPPAGFPSSRSDAERRQACDAILRACNQQLTAKLACPRHLGSLLELAELACDGYLVSTPQRPPLYLERILFVLLRNAAAQGSPEATLRLAQPLHACLVQCSREAAPQDYEAVARGSFSLLWKGAEALLERRAAFAARLKALSFLVLLEDESTPCEVPHFASPTACRAVAAHQLFDA

SEQ ID NO: 29247 - protein, 828 aa, Homo sapiens
  Payload ID: 5704
  Gene Symbol: ELFN1
  Gene Name: extracellular leucine-rich repeat and fibronectin type III domain containing 1
  Uniprot ID: P0C7U0
  ENSP ID: ENSP00000456548
MAGRGWGALWVCVAAATLLHAGGLARADCWLIEGDKGFVWLAICSQNQPPYEAIPQQINSTIVDLRLNENRIRSVQYASLSRFGNLTYLNLTKNEIGYIEDGAFSGQFNLQVLQLGYNRLRNLTEGMLRGLGKLEYLYLQANLIEVVMASSFWECPNIVNIDLSMNRIQQLNSGTFAGLAKLSVCELYSNPFYCSCELLGFLRWLAAFTNATQTYDRMQCESPPVYSGYYLLGQGRRGHRSILSKLQSVCTEDSYAAEVVGPPRPASGRSQPGRSPPPPPPPEPSDMPCADDECFSGDGTTPLVALPTLATQAEARPLIKVKQLTQNSATITVQLPSPFHRMYTLEHFNNSKASTVSRLTKAQEEIRLTNLFTLTNYTYCVVSTSAGLRHNHTCLTICLPRLPSPPGPVPSPSTATHYIMTILGCLFGMVLVLGAVYYCLRRRRRQEEKHKKAASAAAAGSLKKTIIELKYGPELEAPGLAPLSQGPLLGPEAVTRIPYLPAAGEVEQYKLVESADTPKASKGSYMEVRTGDPPERRDCELGRPGPDSQSSVAEISTIAKEVDKVNQIINNCIDALKSESTSFQGVKSGPVSVAEPPLVLLSEPLAAKHGFLAPGYKDAFGHSLQRHHSVEAAGPPRASTSSSGSVRSPRAFRAEAVGVHKAAAAEAKYIEKGSPAADAILTVTPAAAVLRAEAEKGRQYGEHRHSYPGSHPAEPPAPPGPPPPPPHEGLGRKASILEPLTRPRPRDLAYSQLSPQYHSLSYSSSPEYTCRASQSIWERFRLSRRRHKEEEEFMAAGHALRKKVQFAKDEDLHDILDYWKGVSAQHKS

SEQ ID NO: 29248 - protein, 828 aa, Homo sapiens; identical to SEQ ID NO: 29247
  Payload ID: 5704
  Gene Symbol: ELFN1
  Gene Name: extracellular leucine-rich repeat and fibronectin type III domain containing 1
  Uniprot ID: P0C7U0
  ENSP ID: ENSP00000457193

SEQ ID NO: 29249 - protein, 820 aa, Homo sapiens
  Payload ID: 5705
  Gene Symbol: ELFN2
  Gene Name: extracellular leucine-rich repeat and fibronectin type III domain containing 2
  Uniprot ID: Q5R3F8
  ENSP ID: ENSP00000385277
MLRLGLCAAALLCVCRPGAVRADCWLIEGDKGYVWLAICSQNQPPYETIPQHINSTVHDLRLNENKLKAVLYSSLNRFGNLTDLNLTKNEISYIEDGAFLGQSSLQVLQLGYNKLSNLTEGMLRGMSRLQFLFVQHNLIEVVTPTAFSECPSLISIDLSSNRLSRLDGATFASLASLMVCELAGNPFNCECDLFGFLAWLVVFNNVTKNYDRLQCESPREFAGYPLLVPRPYHSLNAITVLQAKCRNGSLPARPVSHPTPYSTDAQREPDENSGFNPDEILSVEPPASSTTDASAGPAIKLHHVTFTSATLVVIIPHPYSKMYILVQYNNSYFSDVMTLKNKKEIVTLDKLRAHTEYTFCVTSLRNSRRFNHTCLTFTTRDPVPGDLAPSTSTTTHYIMTILGCLFGMVIVLGAVYYCLRKRRMQEEKQKSVNVKKTILEMRYGADVDAGSIVHAAQKLGEPPVLPVSRMASIPSMIGEKLPTAKGLEAGLDTPKVATKGNYIEVRTGAGGDGLARPEDDLPDLENGQGSAAEISTIAKEVDKVNQIINNCIDALKLDSASFLGGGSSSGDPELAFECQSLPAAAAASSATGPGALERPSFLSPPYKESSHHPLQRQLSADAAVTRKTCSVSSSGSIKSAKVFSLDVPDHPAATGLAKGDSKYIEKGSPLNSPLDRLPLVPAGSGGGSGGGGGIHHLEVKPAYHCSEHRHSFPALYYEEGADSLSQRVSFLKPLTRSKRDSTYSQLSPRHYYSGYSSSPEYSSESTHKIWERFRPYKKHHREEVYMAAGHALRKKVQFAKDEDLHDILDYWKGVSAQQKL

SEQ ID NO: 29250 - protein, 820 aa, Homo sapiens; identical to SEQ ID NO: 29249
  Payload ID: 5705
  Gene Symbol: ELFN2
  Gene Name: extracellular leucine-rich repeat and fibronectin type III domain containing 2
  Uniprot ID: Q5R3F8
  ENSP ID: ENSP00000480338

SEQ ID NO: 29251 - protein, 415 aa, Homo sapiens
  Payload ID: 5706
  Gene Symbol: ECM1
  Gene Name: extracellular matrix protein 1
  Uniprot ID: Q16610
  ENSP ID: ENSP00000271630
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 29252 - protein, 540 aa, Homo sapiens
  Payload ID: 5706
  Gene Symbol: ECM1
  Gene Name: extracellular matrix protein 1
  Uniprot ID: Q16610
  ENSP ID: ENSP00000358043
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 29253 - protein, 567 aa, Homo sapiens
  Payload ID: 5706
  Gene Symbol: ECM1
  Gene Name: extracellular matrix protein 1
  Uniprot ID: Q16610
  ENSP ID: ENSP00000358045
MGTTARAALVLTYLAVASAASEGGFTATGQRQLRPEHFQEVGYAAPPSPPLSRSLPMDHPDSSQHGPPFEGQSGKEGRGPRPHSQPWLGERVGCSHIPPSIVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 29254 - protein, 699 aa, Homo sapiens
  Payload ID: 5707
  Gene Symbol: ECM2
  Gene Name: extracellular matrix protein 2, female organ and adipocyte specific
  Uniprot ID: O94769
  ENSP ID: ENSP00000344758
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATVSYSLLSGIALNDRNEFSGDSSEQREPTNLLHKQLPPPQVGMDRIVRKEALQSEEDEEVKEEDTEQKRETPESRNQGQLYSEGDSRGGDRKQRPGEERRLAHQQQRQGREEEEDEEEEGEEGEEDEEDEEDPVRGDMFRMPSRSPLPAPPRGTLRLPSGCSLSYRTISCINAMLTQIPPLTAPQITSLELTGNSIASIPDEAFNGLPNLERLDLSKNNITSSGIGPKAFKLLKKLMRLNMDGNNLIQIPSQLPSTLEELKVNENNLQAIDEESLSDLNQLVTLELEGNNLSEANVNPLAFKPLKSLAYLRLGKNKFRIIPQGLPGSIEELYLENNQIEEITEICFNHTRKINVIVLRYNKIEENRIAPLAWINQENLESIDLSYNKLYHVPSYLPKSLLHLVLLGNQIERIPGYVFGHMEPGLEYLYLSFNKLADDGMDRVSFYGAYHSLRELFLDHNDLKSIPPGIQEMKALHFLRLNNNKIRNILPEEICNAEEDDDSNLEHLHLENNYIKIREIPSYTFSCIRSYSSIVLKPQNIK

SEQ ID NO: 29255 - protein, 164 aa, Homo sapiens
  Payload ID: 5707
  Gene Symbol: ECM2
  Gene Name: extracellular matrix protein 2, female organ and adipocyte specific
  ENSP ID: ENSP00000364690
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATGTEI

SEQ ID NO: 29256 - protein, 160 aa, Homo sapiens
  Payload ID: 5707
  Gene Symbol: ECM2
  Gene Name: extracellular matrix protein 2, female organ and adipocyte specific
  ENSP ID: ENSP00000378905
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSAT

SEQ ID NO: 29257 - protein, 643 aa, Homo sapiens
  Payload ID: 5707
  Gene Symbol: ECM2
  Gene Name: extracellular matrix protein 2, female organ and adipocyte specific
  Uniprot ID: O94769
  ENSP ID: ENSP00000393971
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATEQREPTNLLHKQLPPPQVGMDRIVRKEALQSEEDEEVKEEDTEQKRETPESRNQGQLYSEGDSRGGDRKQRPGEERRLAHQQQRQGREEEEDEEEEGEEGEEDEEDEEDPVRGDMFRMPSRSPLPAPPRGTLRLPSGCSLSYRTISCINAMLTQIPPLTAPQITSLELTGNSIASIPDEAFNGLPNLERLDLSKNNITSSGIGPKAFKLLKKLMRLNMDGNNLIQIPSQLPSTLEELKVNENNLQAIDEESLSDLNQLVTLELEGNNLSEANVNPLAFKPLKSLAYLRLGKNKFRIIPQGLPGSIEELYLENNQIEEITEICFNHTRKINVIVLRYNKIEENRIAPLAWINQENLESIDLSYNKLYHVPSYLPKSLLHLVLLGNQIERIPGYVFGHMEPGLEYLYLSFNKLADDGMDRVSFYGAYHSLRELFLDHNDLKSIPPGIQEMKALHFLRLNNNKIRCVSDAVLETVTNRSDVAFPLW

SEQ ID NO: 29258 - protein, 586 aa, Homo sapiens
  Payload ID: 5708
  Gene Symbol: EYA1
  Gene Name: EYA transcriptional coactivator and phosphatase 1
  ENSP ID: ENSP00000303221
MEMQDLTSPHSRLSGSSESPSGPKLGNSHINSNSMTPNGTEVKTEPMSSSETASTTADGSLNNFSGSAIGSSSFSPRPTHQFSPPQIYPSKPYPHILPTPSSQTMAAYGQTQFTTGMQQATAYATYPQPGQPYGISSYGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 29259 - protein, 592 aa, Homo sapiens
  Payload ID: 5708
  Gene Symbol: EYA1
  Gene Name: EYA transcriptional coactivator and phosphatase 1
  Uniprot ID: Q99502
  ENSP ID: ENSP00000342626
MEMQDLTSPHSRLSGSSESPSGPKLGNSHINSNSMTPNGTEVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 29260 - protein, 559 aa, Homo sapiens
  Payload ID: 5708
  Gene Symbol: EYA1
  Gene Name: EYA transcriptional coactivator and phosphatase 1
  Uniprot ID: Q99502
  ENSP ID: ENSP00000373392
MLLFPQVAVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 29261 - protein, 558 aa, Homo sapiens
  Payload ID: 5708
  Gene Symbol: EYA1
  Gene Name: EYA transcriptional coactivator and phosphatase 1
  ENSP ID: ENSP00000373393
MLLFPQVAVKTEPMSSSETASTTADGSLNNFSGSAIGSSSFSPRPTHQFSPPQIYPSKPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 29262 - protein, 592 aa, Homo sapiens; identical to SEQ ID NO: 29259
  Payload ID: 5708
  Gene Symbol: EYA1
  Gene Name: EYA transcriptional coactivator and phosphatase 1
  Uniprot ID: Q99502
  ENSP ID: ENSP00000373394

SEQ ID NO: 29263 - protein, 591 aa, Homo sapiens
  Payload ID: 5708
  Gene Symbol: EYA1
  Gene Name: EYA transcriptional coactivator and phosphatase 1
  ENSP ID: ENSP00000373395
MEMQDLTSPHSRLSGSSESPSGPKLGNSHINSNSMTPNGTEVKTEPMSSSETASTTADGSLNNFSGSAIGSSSFSPRPTHQFSPPQIYPSKPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 29264 - protein, 557 aa, Homo sapiens
  Payload ID: 5708
  Gene Symbol: EYA1
  Gene Name: EYA transcriptional coactivator and phosphatase 1
  Uniprot ID: Q99502
  ENSP ID: ENSP00000410176
MEMQDLTSPHSRLSGSSESPSGPKLGNSHINSNSMTPNGTEVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 29265 - protein, 212 aa, Homo sapiens
  Payload ID: 5708
  Gene Symbol: EYA1
  Gene Name: EYA transcriptional coactivator and phosphatase 1
  ENSP ID: ENSP00000428391
MEMQDLTSPHSRLSGSSESPSGPKLGNSHINSNSMTPNGTEVKTEPMSSSETASTTADGSLNNFSGSAIGSSSFSPRPTHQFSPPQIYPSNLPQECNKLQPMPRTHSQDSRTAFPHMASRLKVDCHSLSHLDRQDFSAMAQASVPLNLDRHHTATRCKVAVLQHHQEYIQEIIHSQIPLDLIVHSRTIRLIPVLARVSTHSIITAHRIQHII

SEQ ID NO: 29266 - protein, 41 aa, Homo sapiens
  Payload ID: 5708
  Gene Symbol: EYA1
  Gene Name: EYA transcriptional coactivator and phosphatase 1
  ENSP ID: ENSP00000428517
MEEMIFNLADTHLFFNDLEESRASRESMMLVKLGRRKPSSA

SEQ ID NO: 29267 - protein, 508 aa, Homo sapiens
  Payload ID: 5709
  Gene Symbol: EYA2
  Gene Name: EYA transcriptional coactivator and phosphatase 2
  ENSP ID: ENSP00000321590
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 29268 - protein, 538 aa, Homo sapiens
  Payload ID: 5709
  Gene Symbol: EYA2
  Gene Name: EYA transcriptional coactivator and phosphatase 2
  Uniprot ID: O00167
  ENSP ID: ENSP00000333640
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 29269 - protein, 459 aa, Homo sapiens
  Payload ID: 5709
  Gene Symbol: EYA2
  Gene Name: EYA transcriptional coactivator and phosphatase 2
  Uniprot ID: O00167
  ENSP ID: ENSP00000349986
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGKESCFERIMQRFGRKAVYVVIGDGVEEEQGAKKHNMPFWRISCHADLEALRHALELEYL

SEQ ID NO: 29270 - protein, 197 aa, Homo sapiens
  Payload ID: 5709
  Gene Symbol: EYA2
  Gene Name: EYA transcriptional coactivator and phosphatase 2
  ENSP ID: ENSP00000395427
QLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLE

SEQ ID NO: 29271 - protein, 514 aa, Homo sapiens
  Payload ID: 5709
  Gene Symbol: EYA2
  Gene Name: EYA transcriptional coactivator and phosphatase 2
  Uniprot ID: O00167
  ENSP ID: ENSP00000417105
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 29272 - protein, 508 aa, Homo sapiens; identical to SEQ ID NO: 29267
  Payload ID: 5709
  Gene Symbol: EYA2
  Gene Name: EYA transcriptional coactivator and phosphatase 2
  ENSP ID: ENSP00000483392

SEQ ID NO: 29273 - protein, 536 aa, Homo sapiens
  Payload ID: 5710
  Gene Symbol: EYA3
  Gene Name: EYA transcriptional coactivator and phosphatase 3
  Uniprot ID: Q99504
  ENSP ID: ENSP00000362970
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQTQPYAVYPQATQTYGLPPFASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQQLYFLDMEALGCQLEPTALILFIQLSGNLSNYNKL

SEQ ID NO: 29274 - protein, 416 aa, Homo sapiens
  Payload ID: 5710
  Gene Symbol: EYA3
  Gene Name: EYA transcriptional coactivator and phosphatase 3
  ENSP ID: ENSP00000362971
MIIPHKCILQTSSTNASLISTSSTIANIPAAAVASISNQDYPTYTILGQNQYQACYPSSSFGVTGQTNSDAESTTLAATTYQSEKPSVMAPAPAAQRLSSDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQHNMPFWRITNHGDLVSLHQALELDFL

SEQ ID NO: 29275 - protein, 573 aa, Homo sapiens
  Payload ID: 5710
  Gene Symbol: EYA3
  Gene Name: EYA transcriptional coactivator and phosphatase 3
  Uniprot ID: Q99504
  ENSP ID: ENSP00000362978
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQTQPYAVYPQATQTYGLPPFGALWPGMKPESGLIQTPSPSQHSVLTCTTGLTTSQPSPAHYSYPIQASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQHNMPFWRITNHGDLVSLHQALELDFL

SEQ ID NO: 29276 - protein, 520 aa, Homo sapiens
  Payload ID: 5710
  Gene Symbol: EYA3
  Gene Name: EYA transcriptional coactivator and phosphatase 3
  Uniprot ID: Q99504
  ENSP ID: ENSP00000405587
MTCTDYIPRSSNDYTSQMYSAKPYAHILSVPVSETAYPGQTQYQTLQQTQPYAVYPQATQTYGLPPFGALWPGMKPESGLIQTPSPSQHSVLTCTTGLTTSQPSPAHYSYPIQASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQHNMPFWRITNHGDLVSLHQALELDFL

SEQ ID NO: 29277 - protein, 527 aa, Homo sapiens
  Payload ID: 5710
  Gene Symbol: EYA3
  Gene Name: EYA transcriptional coactivator and phosphatase 3
  Uniprot ID: Q99504
  ENSP ID: ENSP00000442558
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQTQPYAVYPQATQTYGLPPFASSTNASLISTSSTIANIPAAAVASISNQDYPTYTILGQNQYQACYPSSSFGVTGQTNSDAESTTLAATTYQSEKPSVMAPAPAAQRLSSGDPSTSPSLSQTTPSKDTDDQSRKNMTSKNRGKRKADATSSQDSELERVFLWDLDETIIIFHSLLTGSYAQKYGKDPTVVIGSGLTMEEMIFEVADTHLFFNDLEECDQVHVEDVASDDNGQDLSNYSFSTDGFSGSGGSGSHGSSVGVQGGVDWMRKLAFRYRKVREIYDKHKSNVGGLLSPQRKEALQRLRAEIEVLTDSWLGTALKSLLLIQSRKNCVNVLITTTQLVPALAKVLLYGLGEIFPIENIYSATKIGKESCFERIVSRFGKKVTYVVIGDGRDEEIAAKQHNMPFWRITNHGDLVSLHQALELDFL

SEQ ID NO: 29278 - protein, 639 aa, Homo sapiens
  Payload ID: 5711
  Gene Symbol: EYA4
  Gene Name: EYA transcriptional coactivator and phosphatase 4
  Uniprot ID: O95677
  ENSP ID: ENSP00000347294
MEDSQDLNEQSVKKTCTESDVSQSQNSRSMEMQDLASPHTLVGGGDTPGSSKLEKSNLSSTSVTTNGTGGENMTVLNTADWLLSCNTPSSATMSLLAVKTEPLNSSETTATTGDGALDTFTGSVITSSGYSPRSAHQYSPQLYPSKPYPHILSTPAAQTMSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIVSRFGTNITYVVIGDGRDEEHAANQHNMPFWRISSHSDLLALHQALELEYL

SEQ ID NO: 29279 - protein, 616 aa, Homo sapiens
  Payload ID: 5711
  Gene Symbol: EYA4
  Gene Name: EYA transcriptional coactivator and phosphatase 4
  Uniprot ID: O95677
  ENSP ID: ENSP00000347434
MEDSQDLNEQSVKKTCTESDVSQSQNSRSMEMQDLASPHTLVGGGDTPGSSKLEKSNLSSTSVTTNGTGVSLLAVKTEPLNSSETTATTGDGALDTFTGSVITSSGYSPRSAHQYSPQLYPSKPYPHILSTPAAQTMSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIMQRFGRKVVYVVIGDGVEEEQAAKKHNMPFWRISSHSDLLALHQALELEYL

SEQ ID NO: 29280 - protein, 639 aa, Homo sapiens
  Payload ID: 5711
  Gene Symbol: EYA4
  Gene Name: EYA transcriptional coactivator and phosphatase 4
  Uniprot ID: O95677
  ENSP ID: ENSP00000356870
MEDSQDLNEQSVKKTCTESDVSQSQNSRSMEMQDLASPHTLVGGGDTPGSSKLEKSNLSSTSVTTNGTGGENMTVLNTADWLLSCNTPSSATMSLLAVKTEPLNSSETTATTGDGALDTFTGSVITSSGYSPRSAHQYSPQLYPSKPYPHILSTPAAQTMSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIMQRFGRKVVYVVIGDGVEEEQAAKKHNMPFWRISSHSDLLALHQALELEYL

SEQ ID NO: 29281 - protein, 570 aa, Homo sapiens
  Payload ID: 5711
  Gene Symbol: EYA4
  Gene Name: EYA transcriptional coactivator and phosphatase 4
  ENSP ID: ENSP00000388670
MEDSQDLNEQSVKKTCTESDVSQSQNSRSMEMQDLASPHTLVGGGDTPGSSKLEKSNLSSTSVTTNGTGVITSSGYSPRSAHQYSPQLYPSKPYPHILSTPAAQTMSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGTDLHPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIVSRFGTNITYVVIGDGRDEEHAANQKRLPA

SEQ ID NO: 29282 - protein, 585 aa, Homo sapiens
  Payload ID: 5711
  Gene Symbol: EYA4
  Gene Name: EYA transcriptional coactivator and phosphatase 4
  Uniprot ID: O95677
  ENSP ID: ENSP00000395916
MEDSQDLNEQSVKKTCTESDVSQSQNSRSMEMQDLASPHTLVGGGDTPGSSKLEKSNLSSTSVTTNGTGVITSSGYSPRSAHQYSPQLYPSKPYPHILSTPAAQTMSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIVSRFGTNITYVVIGDGRDEEHAANQHNMPFWRISSHSDLLALHQALELEYL

SEQ ID NO: 29283 - protein, 639 aa, Homo sapiens; identical to SEQ ID NO: 29278
  Payload ID: 5711
  Gene Symbol: EYA4
  Gene Name: EYA transcriptional coactivator and phosphatase 4
  Uniprot ID: O95677
  ENSP ID: ENSP00000404558

SEQ ID NO: 29284 - protein, 645 aa, Homo sapiens
  Payload ID: 5711
  Gene Symbol: EYA4
  Gene Name: EYA transcriptional coactivator and phosphatase 4
  ENSP ID: ENSP00000432770
MEDSQDLNEQSVKKTCTESDVSQSQNSRSMEMQDLASPHTLVGGGDTPGSSKLEKSNLSSTSVTTNGTGGENMTVLNTADWLLSCNTPSSATMSLLAVKTEPLNSSETTATTGDGALDTFTGSVITSSGYSPRSAHQYSPQLYPSKPYPHILSTPAAQTMSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGTDLHPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIMQRFGRKVVYVVIGDGVEEEQAAKKHNMPFWRISSHSDLLALHQALELEYL

SEQ ID NO: 29285 - protein, 616 aa, Homo sapiens
  Payload ID: 5711
  Gene Symbol: EYA4
  Gene Name: EYA transcriptional coactivator and phosphatase 4
  ENSP ID: ENSP00000433219
MEDSQDLNEQSVKKTCTESDVSQSQNSRSMEMQDLASPHTLVGGGDTPGSSKLEKSNLSSTSVTTNGTGVSLLAVKTEPLNSSETTATTGDGALDTFTGSVITSSGYSPRSAHQYSPQLYPSKPYPHILSTPAAQTMSAYAGQTQYSGMQQPAVYTAYSQTGQPYSLPTYDLGVMLPAIKTESGLSQTQSPLQSGCLSYSPGFSTPQPGQTPYSYQMPGSSFAPSSTIYANNSVSNSTNFSGSQQDYPSYTAFGQNQYAQYYSASTYGAYMTSNNTADGTPSSTSTYQLQESLPGLTNQPGEFDTMQSPSTPIKDLDERTCRSSGSKSRGRGRKNNPSPPPDSDLERVFVWDLDETIIVFHSLLTGSYAQKYGKDPPMAVTLGLRMEEMIFNLADTHLFFNDLEECDQVHIDDVSSDDNGQDLSTYSFATDGFHAAASSANLCLPTGVRGGVDWMRKLAFRYRRVKELYNTYKNNVGGLLGPAKRDAWLQLRAEIEGLTDSWLTNALKSLSIISTRSNCINVLVTTTQLIPALAKVLLYSLGGAFPIENIYSATKIGKESCFERIVSRFGTNITYVVIGDGRDEEHAANQHNMPFWRISSHSDLLALHQALELEYL

SEQ ID NO: 29286 - protein, 594 aa, Homo sapiens
  Payload ID: 5712
  Gene Symbol: EYS
  Gene Name: eyes shut homolog (Drosophila)
  Uniprot ID: Q5T1H1
  ENSP ID: ENSP00000341818
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRYLCII

SEQ ID NO: 29287 - protein, 3165 aa, Homo sapiens
  Payload ID: 5712
  Gene Symbol: EYS
  Gene Name: eyes shut homolog (Drosophila)
  Uniprot ID: Q5T1H1
  ENSP ID: ENSP00000359650
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRCSCSLSYIGRLCVVNVDYCLGNHSISVHGLCLALSHNCNCSGLQRYERNICEIDTEDCKSASCKNGTTSTHLRGYFFRKCVPGFKGTQCEIDIDECASHPCKNGATCIDQPGNYFCQCVPPFKVVDGFSCLCNPGYVGIRCEQDIDDCILNACEHNSTCKDLHLSYQCVCLSDWEGNFCEQESNECKMNPCKNNSTCTDLYKSYRCECTSGWTGQNCSEEINECDSDPCMNGGLCHESTIPGQFVCLCPPLYTGQFCHQRYNLCDLLHNPCRNNSTCLALVDANQHCICREEFEGKNCEIDVKDCLFLSCQDYGDCEDMVNNFRCICRPGFSGSLCEIEINECSSEPCKNNGTCVDLTNRFFCNCEPEYHGPFCELDVNKCKISPCLDEENCVYRTDGYNCLCAPGYTGINCEINLDECLSEPCLHDGVCIDGINHYTCDCKSGFFGTHCETNANDCLSNPCLHGRCTELINEYPCSCDADGTSTQCKIKINDCTSIPCMNEGFCQKSAHGFTCICPRGYTGAYCEKSIDNCAEPELNSVICLNGGICVDGPGHTFDCRCLPGFSGQFCEININECSSSPCLHGADCEDHINGYVCKCQPGWSGHHCENELECIPNSCVHELCMENEPGSTCLCTPGFMTCSIGLLCGDEIRRITCLTPIFQRTDPISTQTYTIPPSETLVSSFPSIKATRIPAIMDTYPVDQGPKQTGIVKHDILPTTGLATLRISTPLESYLLQELIVTRELSAKHSLLSSADVSSSRFLNFGIRDPAQIVQDKTSVSHMPIRTSAATLGFFFPDRRARTPFIMSSLMSDFIFPTQSLLFENCQTVALSATPTTSVIRSIPGADIELNRQSLLSRGFLLIAASISATPVVSRGAQEDIEEYSADSLISRREHWRLLSPSMSPIFPAKVIISKQVTILNSSALHRFSTKAFNPSEYQAITEASSNQRLTNIKSQAADSLRELSQTCATCSMTEIKSSREFSDQVLHSKQSHFYETFWMNSAILASWYALMGAQTITSGHSFSSATEITPSVAFTEVPSLFPSKKSAKRTILSSSLEESITLSSNLDVNLCLDKTCLSIVPSQTISSDLMNSDLTSKMTTDELSVSENILKLLKIRQYGITMGPTEVLNQESLLDMEKSKGSHTLFKLHPSDSSLDFELNLQIYPDVTLKTYSEITHANDFKNNLPPLTGSVPDFSEVTTNVAFYTVSATPALSIQTSSSMSVIRPDWPYFTDYMTSLKKEVKTSSEWSKWELQPSVQYQEFPTASRHLPFTRSLTLSSLESILAPQRLMISDFSCVRYYGDSYLEFQNVALNPQNNISLEFQTFSSYGLLLYVKQDSNLVDGFFIQLFIENGTLKYHFYCPGEAKFKSINTTVRVDNGQKYTLLIRQELDPCNAELTILGRNTQICESINHVLGKPLPKSGSVFIGGFPDLHGKIQMPVPVKNFTGCIEVIEINNWRSFIPSKAVKNYHINNCRSQGFMLSPTASFVDASDVTQGVDTMWTSVSPSVAAPSVCQQDVCHNGGTCHAIFLSSGIVSFQCDCPLHFTGRFCEKDAGLFFPSFNGNSYLELPFLKFVLEKEHNRTVTIYLTIKTNSLNGTILYSNGNNCGKQFLHLFLVEGRPSVKYGCGNSQNILTVSANYSINTNAFTPITIRYTTPVGSPGVVCMIEMTADGKPPVQKKDTEISHASQAYFESMFLGHIPANVQIHKKAGPVYGFRGCILDLQVNNKEFFIIDEARHGKNIENCHVPWCAHHLCRNNGTCISDNENLFCECPRLYSGKLCQFASCENNPCGNGATCVPKSGTDIVCLCPYGRSGPLCTDAINITQPRFSGTDAFGYTSFLAYSRISDISFHYEFHLKFQLANNHSALQNNLIFFTGQKGHGLNGDDFLAVGLLNGSVVYSYNLGSGIASIRSEPLNLSLGVHTVHLGKFFQEGWLKVDDHKNKSIIAPGRLVGLNVFSQFYVGGYSEYTPDLLPNGADFKNGFQGCIFTLQVRTEKDGHFRGLGNPEGHPNAGRSVGQCHASPCSLMKCGNGGTCIESGTSVYCNCTTGWKGSFCTETVSTCDPEHDPPHHCSRGATCISLPHGYTCFCPLGTTGIYCEQALILIVILEKPKPAERKVKKEALSISDPSFRSNELSWMSFASFHVRKKTHIQLQFQPLAADGILFYAAQHLKAQSGDFLCISLVNSSVQLRYNLGDRTIILETLQKVTINGSTWHIIKAGRVGAEGYLDLDGINVTEKASTKMSSLDTNTDFYIGGVSSLNLVNPMAIENEPVGFQGCIRQVIINNQELQLTEFGAKGGSNVGDCDGTACGYNTCRNGGECTVNGTTFSCRCLPDWAGNTCNQSVSCLNNLCLHQSLCIPDQSFSYSCLCTLGWVGRYCENKTSFSTAKFMGNSYIKYIDPNYRMRNLQFTTISLNFSTTKTEGLIVWMGIAQNEENDFLAIGLHNQTLKIAVNLGERISVPMSYNNGTFCCNKWHHVVVIQNQTLIKAYINNSLILSEDIDPHKNFVALNYDGICYLGGFEYGRKVNIVTQEIFKTNFVGKIKDVVFFQEPKNIELIKLEGYNVYDGDEQNEVT

SEQ ID NO: 29288 - protein, 3144 aa, Homo sapiens
  Payload ID: 5712
  Gene Symbol: EYS
  Gene Name: eyes shut homolog (Drosophila)
  Uniprot ID: Q5T1H1
  ENSP ID: ENSP00000359652
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRCSCSLSYIGRLCVVNVDYCLGNHSISVHGLCLALSHNCNCSGLQRYERNICEIDTEDCKSASCKNGTTSTHLRGYFFRKCVPGFKGTQCEIDIDECASHPCKNGATCIDQPGNYFCQCVPPFKVVDGFSCLCNPGYVGIRCEQDIDDCILNACEHNSTCKDLHLSYQCVCLSDWEGNFCEQESNECKMNPCKNNSTCTDLYKSYRCECTSGWTGQNCSEEINECDSDPCMNGGLCHESTIPGQFVCLCPPLYTGQFCHQRYNLCDLLHNPCRNNSTCLALVDANQHCICREEFEGKNCEIDVKDCLFLSCQDYGDCEDMVNNFRCICRPGFSGSLCEIEINECSSEPCKNNGTCVDLTNRFFCNCEPEYHGPFCELDVNKCKISPCLDEENCVYRTDGYNCLCAPGYTGINCEINLDECLSEPCLHDGVCIDGINHYTCDCKSGFFGTHCETNANDCLSNPCLHGRCTELINEYPCSCDADGTSTQCKIKINDCTSIPCMNEGFCQKSAHGFTCICPRGYTGAYCEKSIDNCAEPELNSVICLNGGICVDGPGHTFDCRCLPGFSGQFCEININECSSSPCLHGADCEDHINGYVCKCQPGWSGHHCENELECIPNSCVHELCMENEPGSTCLCTPGFMTCSIGLLCGDEIRRITCLTPIFQRTDPISTQTYTIPPSETLVSSFPSIKATRIPAIMDTYPVDQGPKQTGIVKHDILPTTGLATLRISTPLESYLLQELIVTRELSAKHSLLSSADVSSSRFLNFGIRDPAQIVQDKTSVSHMPIRTSAATLGFFFPDRRARTPFIMSSLMSDFIFPTQSLLFENCQTVALSATPTTSVIRSIPGADIELNRQSLLSRGFLLIAASISATPVVSRGAQEDIEEYSADSLISRREHWRLLSPSMSPIFPAKVIISKQVTILNSSALHRFSTKAFNPSEYQAITEASSNQRLTNIKSQAADSLRELSQTCATCSMTEIKSSREFSDQVLHSKQSHFYETFWMNSAILASWYALMGAQTITSGHSFSSATEITPSVAFTEVPSLFPSKKSAKRTILSSSLEESITLSSNLDVNLCLDKTCLSIVPSQTISSDLMNSDLTSKMTTDELSVSENILKLLKIRQYGITMGPTEVLNQESLLDMEKSKGSHTLFKLHPSDSSLDFELNLQIYPDVTLKTYSEITHANDFKNNLPPLTGSVPDFSEVTTNVAFYTVSATPALSIQTSSSMSVIRPDWPYFTDYMTSLKKEVKTSSEWSKWELQPSVQYQEFPTASRHLPFTRSLTLSSLESILAPQRLMISDFSCVRYYGDSYLEFQNVALNPQNNISLEFQTFSSYGLLLYVKQDSNLVDGFFIQLFIENGTLKYHFYCPGEAKFKSINTTVRVDNGQKYTLLIRQELDPCNAELTILGRNTQICESINHVLGKPLPKSGSVFIGGFPDLHGKIQMPVPVKNFTGCIEVIEINNWRSFIPSKAVKNYHINNCRSQGFMLSPTASFVDASDVTQGVDTMWTSVSPSVAAPSVCQQDVCHNGGTCHAIFLSSGIVSFQCDCPLHFTGRFCEKDAGLFFPSFNGNSYLELPFLKFVLEKEHNRTVTIYLTIKTNSLNGTILYSNGNNCGKQFLHLFLVEGRPSVKYGCGNSQNILTVSANYSINTNAFTPITIRYTTPVGSPGVVCMIEMTADGKPPVQKKDTEISHASQAYFESMFLGHIPANVQIHKKAGPVYGFRGCILDLQVNNKEFFIIDEARHGKNIENCHVPWCAHHLCRNNGTCISDNENLFCECPRLYSGKLCQFASCENNPCGNGATCVPKSGTDIVCLCPYGRSGPLCTDAINITQPRFSGTDAFGYTSFLAYSRISDISFHYEFHLKFQLANNHSALQNNLIFFTGQKGHGLNGDDFLAVGLLNGSVVYSYNLGSGIASIRSEPLNLSLGVHTVHLGKFFQEGWLKVDDHKNKSIIAPGRLVGLNVFSQFYVGGYSEYTPDLLPNGADFKNGFQGCIFTLQVRTEKDGHFRGLGNPEGHPNAGRSVGQCHASPCSLMKCGNGGTCIESGTSVYCNCTTGWKGSFCTETVSTCDPEHDPPHHCSRGATCISLPHGYTCFCPLGTTGIYCEQALSISDPSFRSNELSWMSFASFHVRKKTHIQLQFQPLAADGILFYAAQHLKAQSGDFLCISLVNSSVQLRYNLGDRTIILETLQKVTINGSTWHIIKAGRVGAEGYLDLDGINVTEKASTKMSSLDTNTDFYIGGVSSLNLVNPMAIENEPVGFQGCIRQVIINNQELQLTEFGAKGGSNVGDCDGTACGYNTCRNGGECTVNGTTFSCRCLPDWAGNTCNQSVSCLNNLCLHQSLCIPDQSFSYSCLCTLGWVGRYCENKTSFSTAKFMGNSYIKYIDPNYRMRNLQFTTISLNFSTTKTEGLIVWMGIAQNEENDFLAIGLHNQTLKIAVNLGERISVPMSYNNGTFCCNKWHHVVVIQNQTLIKAYINNSLILSEDIDPHKNFVALNYDGICYLGGFEYGRKVNIVTQEIFKTNFVGKIKDVVFFQEPKNIELIKLEGYNVYDGDEQNEVT

SEQ ID NO: 29289 - protein, 3165 aa, Homo sapiens; identical to SEQ ID NO: 29287
  Payload ID: 5712
  Gene Symbol: EYS
  Gene Name: eyes shut homolog (Drosophila)
  Uniprot ID: Q5T1H1
  ENSP ID: ENSP00000359655

SEQ ID NO: 29290 - protein, 619 aa, Homo sapiens
  Payload ID: 5712
  Gene Symbol: EYS
  Gene Name: eyes shut homolog (Drosophila)
  Uniprot ID: Q5T1H1
  ENSP ID: ENSP00000377042
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRRILNTVIPHQIQQHIERFIQHDQVGFIVRI

SEQ ID NO: 29291 - protein, 473 aa, Homo sapiens
  Payload ID: 5712
  Gene Symbol: EYS
  Gene Name: eyes shut homolog (Drosophila)
  ENSP ID: ENSP00000381585
  MOD_RES (1)..(1): Any amino acid
XSINTNAFTPITIRYTTPVGSPGVVCMIEMTADGKPPVQKKDTEISHASQAYFESMFLGHIPANVQIHKKAGPVYGFRGCILDLQVNNKEFFIIDEARHGKNIENCHVPWCAHHLCRNNGTCISDNENLFCECPRLYSGKLCQFASCENNPCGNGATCVPKSGTDIVCLCPYGRSGPLCTDAINITQPRFSGTDAFGYTSFLAYSRISDISFHYEFHLKFQLANNHSALQNNLIFFTGQKGHGLNGDDFLAVGLLNGSVVYSYNLGSGIASIRSEPLNLSLGVHTVHLGKFFQEGWLKVDDHKNKSIIAPGRLVGLNVFSQFYVGGYSEYTPDLLPNGADFKNGFQGCIFTLQVRTEKDGHFRGLGNPEGHPNAGRSVGQCHASPCSLMKCGNGGTCIESGTSVYCNCTTGWKGSFCTETVSTCDPEHDPPHHCSRGATCISLPHGYTCFCPLGTTGIYCEQGHQFIGKDVFK

SEQ ID NO: 29292 - protein, 152 aa, Homo sapiens
  Payload ID: 5712
  Gene Symbol: EYS
  Gene Name: eyes shut homolog (Drosophila)
  ENSP ID: ENSP00000420530
MNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGLLGGK

SEQ ID NO: 29293 - protein, 3144 aa, Homo sapiens; identical to SEQ ID NO: 29288
  Payload ID: 5712
  Gene Symbol: EYS
  Gene Name: eyes shut homolog (Drosophila)
  Uniprot ID: Q5T1H1
  ENSP ID: ENSP00000424243

SEQ ID NO: 29294 - protein, 586 aa, Homo sapiens
  Payload ID: 5713
  Gene Symbol: EZR
  Gene Name: ezrin
  Uniprot ID: P15311
  ENSP ID: ENSP00000338934
MPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 29295 - protein, 586 aa, Homo sapiens; identical to SEQ ID NO: 29294
  Payload ID: 5713
  Gene Symbol: EZR
  Gene Name: ezrin
  Uniprot ID: P15311
  ENSP ID: ENSP00000356042

SEQ ID NO: 29296 - protein, 586 aa, Homo sapiens [sequence omitted]

SEQ ID NO: 29297 - protein, 299 aa, Homo sapiens
  Payload ID: 5714
  Gene Symbol: F11R
  Gene Name: F11 receptor
  Uniprot ID: Q9Y624
  ENSP ID: ENSP00000357005
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 29298 - protein, 250 aa, Homo sapiens
  Payload ID: 5714
  Gene Symbol: F11R
  Gene Name: F11 receptor
  Uniprot ID: Q9Y624
  ENSP ID: ENSP00000440812
MGTKAQVERKLLCLFILAILLCSLALGSVTVHSSEPEVRIPENNPVKLSCAYSGFSSPRVEWKFDQGDTTRLVCYNNKITVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 29299 - protein, 279 aa, Homo sapiens [sequence omitted]

SEQ ID NO: 29300 - protein, 520 aa, Homo sapiens
  Payload ID: 5715
  Gene Symbol: FIP1L1
  Gene Name: factor interacting with PAPOLA and CPSF1
  Uniprot ID: Q6UN15
  ENSP ID: ENSP00000302993
MSAGEVERLVSELSGGTGGDEEEEWLYGDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITVQQGRTGNSEKETALPSTKAEFTSPPSLFKTGLPPSRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 29301 - protein, 594 aa, Homo sapiens
  Payload ID: 5715
  Gene Symbol: FIP1L1
  Gene Name: factor interacting with PAPOLA and CPSF1
  Uniprot ID: Q6UN15
  ENSP ID: ENSP00000336752
MSAGEVERLVSELSGGTGGDEEEEWLYGGPWDVHVHSDLAKDLDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITAEDCTMEVTPGAEIQDGRFNLFKVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 29302 - protein, 588 aa, Homo sapiens
  Payload ID: 5715
  Gene Symbol: FIP1L1
  Gene Name: factor interacting with PAPOLA and CPSF1
  Uniprot ID: Q6UN15
  ENSP ID: ENSP00000351383
MSAGEVERLVSELSGGTGGDEEEEWLYGDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITAEDCTMEVTPGAEIQDGRFNLFKVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGIPITVPPPGFPPPPGAPPPSLIPTIESGHSSGYDSRSARAFPYGNVAFPHLPGSAPSWPSLVDTSKQWDYYARREKDRDRERDRDRERDRDRDRERERTRERERERDHSPTPSVFNSDEERYRYREYAERGYERHRASREKEERHRERRHREKEETRHKSSRSNSRRRHESEEGDSHRRHKHKKSKRSKEGKEAGSEPAPEQESTEATPAE

SEQ ID NO: 29303 - protein, 26 aa, Homo sapiens
  Payload ID: 5715
  Gene Symbol: FIP1L1
  Gene Name: factor interacting with PAPOLA and CPSF1
  ENSP ID: ENSP00000421241
  MOD_RES (1)..(1): Any amino acid
XANPPSGIEDETAENGVPKPGQKSKE

SEQ ID NO: 29304 - protein, 254 aa, Homo sapiens [sequence omitted]

SEQ ID NO: 29305 - protein, 378 aa, Homo sapiens
  Payload ID: 5715
  Gene Symbol: FIP1L1
  Gene Name: factor interacting with PAPOLA and CPSF1
  Uniprot ID: Q6UN15
  ENSP ID: ENSP00000425456
MSAGEVERLVSELSGGTGGDEEEEWLYGDENEVERPEEENASANPPSGIEDETAENGVPKPKVTETEDDSDSDSDDDEDDVHVTIGDIKTGAPQYGSYGTAPVNLNIKTGGRVYGTTGTKVKGVDLDAPGSINGVPLLEVDLDSFEDKPWRKPGADLSDYFNYGFNEDTWKAYCEKQKRIRMGLEVIPVTSTTNKITAEDCTMEVTPGAEIQDGRFNLFKVQQGRTGNSEKETALPSTKAEFTSPPSLFKTGLPPSRNSTSSQSQTSTASRKANSSVGKWQDRYGRAESPDLRRLPGAIDVIGQTITISRVEGRRRANENSNIQVLSERSATEVDNNFSKPPPFFPPGAPPTHLPPPPFLPPPPTVSTAPPLIPPPGK

SEQ ID NO: 29306 - protein, 486 aa, Homo sapiens
  Payload ID: 5716
  Gene Symbol: FOXRED1
  Gene Name: FAD-dependent oxidoreductase domain containing 1
  Uniprot ID: Q96CU9
  ENSP ID: ENSP00000263578
MIRRVLPHGMGRGLLTRRPGTRRGGFSLDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINEYLAVVDAPPLDLRFNPSGYLLLASEKDAAAMESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 29307 - protein, 472 aa, Homo sapiens
  Payload ID: 5716
  Gene Symbol: FOXRED1
  Gene Name: FAD-dependent oxidoreductase domain containing 1
  Uniprot ID: Q96CU9
  ENSP ID: ENSP00000434178
MAHTGRTVGRLGEGDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINEYLAVVDAPPLDLRFNPSGYLLLASEKDAAAMESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 29308 - protein, 48 aa, Homo sapiens
  Payload ID: 5716
  Gene Symbol: FOXRED1
  Gene Name: FAD-dependent oxidoreductase domain containing 1
  ENSP ID: ENSP00000434739
MIRRVLPHGMGRGLLTRRPGTRRGGFSLVFTGLHWALSRWDLSAVLIA

SEQ ID NO: 29309 - protein, 185 aa, Homo sapiens
  Payload ID: 5716
  Gene Symbol: FOXRED1
  Gene Name: FAD-dependent oxidoreductase domain containing 1
  ENSP ID: ENSP00000436374
MIRRVLPHGMGRGLLTRRPGTRRGGFSLDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINYLAVVDAPPLDLRFNPSGYLLLASEKDAAAMESNVKVQRDGGRRLV

SEQ ID NO: 29310 - protein, 684 aa, Homo sapiens
  Payload ID: 5717
  Gene Symbol: FOXRED2
  Gene Name: FAD-dependent oxidoreductase domain containing 2
  Uniprot ID: Q8IWF2
  ENSP ID: ENSP00000216187
MGLSAAAPLWGPPGLLLAIALHPALSVPPRRDYCVLGAGPAGLQMAYFLQRAGRDYAVFERAPRPGSFFTRYPRHRKLISINKRYTGKANAEFNLRHDWNSLLSHDPRLLFRHYSRAYFPDARDMVRYLGDFADTLGLRVQYNTTIAHVTLDKDRQAWNGHYFILTDQKGQVHQCSVLFVATGLSVPNQVDFPGSEYAEGYESVSVDPEDFVGQNVLILGRGNSAFETAENILGVTNFIHMLSRSRVRLSWATHYVGDLRAINNGLLDTYQLKSLDGLLESDLTDLAILKDSKGKFHVTPKFFLEEANTNQSADSITLPQDDNDNFAMRVPYDRVIRCLGWNFDFSIFNKSLRLNSGNAFGKKYPLIRASYESKGSRGLFILGTASHSVDYRKSAGGFIHGFRYTVRAVHRLLEHRHHSVTWPATELPITQLTSSIVRRVNEASGLYQMFGVLADVILLKENSTAFEYLEEFPIQMLAQLETLTGRKAKHGLFVINMEYGRNFSGPDKDVFFDDRSVGHTEDAWQSNFLHPVIYYYRYLPTEQEVRFRPAHWPLPRPTAIHHIVEDFLTDWTAPIGHILPLRRFLENCLDTDLRSFYAESCFLFALTRQKLPPFCQQGYLRMQGLVSTESLWQHRVESRLLRDYAPTGRRLEDSSQQLGDQEPLGSPLAPGPLAQSVDSNKEEL

SEQ ID NO: 29311 - protein, 684 aa, Homo sapiens; identical to SEQ ID NO: 29310
  Payload ID: 5717
  Gene Symbol: FOXRED2
  Gene Name: FAD-dependent oxidoreductase domain containing 2
  Uniprot ID: Q8IWF2
  ENSP ID: ENSP00000380400

SEQ ID NO: 29312 - protein, 684 aa, Homo sapiens; identical to SEQ ID NO: 29310
  Payload ID: 5717
  Gene Symbol: FOXRED2
  Gene Name: FAD-dependent oxidoreductase domain containing 2
  Uniprot ID: Q8IWF2
  ENSP ID: ENSP00000380401

SEQ ID NO: 29313 - protein, 86 aa, Homo sapiens
  Payload ID: 5717
  Gene Symbol: FOXRED2
  Gene Name: FAD-dependent oxidoreductase domain containing 2
  ENSP ID: ENSP00000409692
MGLSAAAPLWGPPGLLLAIALHPALSVPPRRDYCVLGAGPAGLQMAYFLQRAGRDYAVFERAPRPGSFFTRYPRHRKLISINKRYT

SEQ ID NO: 29314 - protein, 409 aa, Homo sapiens
  Payload ID: 5718
  Gene Symbol: FAXC
  Gene Name: failed axon connections homolog
  Uniprot ID: Q5TGI0
  ENSP ID: ENSP00000374328
MHWGVGFASSRPCVVDLSWNQSISFFGWWAGSEEPFSFYGDIIAFPLQDYGGIMAGLGSDPWWKKTLYLTGGALLAAAAYLLHELLVIRKQQEIDSKDAIILHQFARPNNGVPSLSPFCLKMETYLRMADLPYQNYFGGKLSAQGKMPWIEYNHEKVSGTEFIIDFLEEKLGVNLNKNLGPHERAISRAVTKMVEEHFYWTLAYCQWVDNLNETRKMLSLSGGGPFSNLLRWVVCHITKGIVKREMHGHGIGRFSEEEIYMLMEKDMRSLAGLLGDKKYIMGPKLSTLDATVFGHLAQAMWTLPGTRPERLIKGELINLAMYCERIRRKFWPEWHHDDDNTIYESEESSEGSKTHTPLLDFSFYSRTETFEDEGAENSFSRTPDTDFTGHSLFDSDVDMDDYTDHEQCK

SEQ ID NO: 29315 - protein, 129 aa, Homo sapiens
  Payload ID: 5718
  Gene Symbol: FAXC
  Gene Name: failed axon connections homolog
  Uniprot ID: Q5TGI0
  ENSP ID: ENSP00000445267
MGPKLSTLDATVFGHLAQAMWTLPGTRPERLIKGELINLAMYCERIRRKFWPEWHHDDDNTIYESEESSEGSKTHTPLLDFSFYSRTETFEDEGAENSFSRTPDTDFTGHSLFDSDVDMDDYTDHEQCK

SEQ ID NO: 29316 - protein, 351 aa, Homo sapiens
  Payload ID: 5719
  Gene Symbol: FAM47E-STBD1
  Gene Name: FAM47E-STBD1 readthrough
  ENSP ID: ENSP00000422067
MADRRRRLRPGTLAPVREGVNCRSRCFTKHKNGLKFPTSLHSRQLVFPRKGLDDFRKGCPPCTGLVTQVPVEGFLPQIYHRAPQLAPKKRQIKLLKEADVLSKLSPAQQARKAFLEDVEAHLTPHPLALYLNLEEAMPIELLSKVLEVLDPDRKLEDTWAYCQDTRKGMKEPTKLLKKHSTQVYLGPSKKTSVSNAGQWLYEEKPHKMDLLHENGPRPGLHENGISDIDEEFILKQFDIDYETKPSHDALHTMKLNQVPLELKRSVGLSKLQETEFFQKLGYERKLQKPQNPYKPKWVKMRYGAWYLNPKLWKKQRVDEPLVDPEVSHKAQEENFKKELQEQSIFKKAMDI

SEQ ID NO: 29317 - protein, 191 aa, Homo sapiens
  Payload ID: 5719
  Gene Symbol: FAM47E-STBD1
  Gene Name: FAM47E-STBD1 readthrough
  ENSP ID: ENSP00000423044
KKHSTQVYLGPSKKTSVSNAGQWLYEEKPHKMDLLHENGPRPGLHENVCKAVSDFCKWVTTFGISDIDEEFILKQFDIDYETKPSHDALHTMKLNQVPLELKRSVGLSKLQETEFFQKLGYERKLQKPQVCWSLLEVHSRPYLPGYHQWRLQNSKDCCLLLLLEASSWRGPSLMPARALLYESIFKKAMDI

SEQ ID NO: 29318 - protein, 53 aa, Homo sapiens
  Payload ID: 5719
  Gene Symbol: FAM47E-STBD1
  Gene Name: FAM47E-STBD1 readthrough
  ENSP ID: ENSP00000424458
MADRRRRLRPGTLAPVREGVNCRSSSYQRCWKCLILTGSWRTHGLIVRTPGKE

SEQ ID NO: 29319 - protein, 53 aa, Homo sapiens; identical to SEQ ID NO: 29318
  Payload ID: 5719
  Gene Symbol: FAM47E-STBD1
  Gene Name: FAM47E-STBD1 readthrough
  ENSP ID: ENSP00000425528

SEQ ID NO: 29320 - protein, 135 aa, Homo sapiens
  Payload ID: 5720
  Gene Symbol: FAM101A
  Gene Name: family with sequence similarity 101, member A
  Uniprot ID: Q6ZTI6
  ENSP ID: ENSP00000315626
MRPRMLPVFFGESIKVNPEPTHEIRCNSEVKYASEKHFQDKVFYAPVPTVTAYSETIVAAPNCTWRNYRSQLTLEPRPRALRFRSTTIIFPKHARSTFRTTLHCSLGRPSRWFTASVQLQLCQDPAPSLLGPATL

SEQ ID NO: 29321 - protein, 135 aa, Homo sapiens; identical to SEQ ID NO: 29320
  Payload ID: 5720
  Gene Symbol: FAM101A
  Gene Name: family with sequence similarity 101, member A
  Uniprot ID: Q6ZTI6
  ENSP ID: ENSP00000345898

SEQ ID NO: 29322 - protein, 135 aa, Homo sapiens; identical to SEQ ID NO: 29320
  Payload ID: 5720
  Gene Symbol: FAM101A
  Gene Name: family with sequence similarity 101, member A
  Uniprot ID: Q6ZTI6
  ENSP ID: ENSP00000374377

SEQ ID NO: 29323 - protein, 216 aa, Homo sapiens
  Payload ID: 5720
  Gene Symbol: FAM101A
  Gene Name: family with sequence similarity 101, member A
  Uniprot ID: Q6ZTI6
  ENSP ID: ENSP00000444080
MVGHLHLQGMEDSLKEQGREGLLDSPDSGLPPSPSPSPPFYSLAPGILDARAGGAGASSEPPGPSEARAPPSQLPNPPASEMRPRMLPVFFGESIKVNPEPTHEIRCNSEVKYASEKHFQDKVFYAPVPTVTAYSETIVAAPNCTWRNYRSQLTLEPRPRALRFRSTTIIFPKHARSTFRTTLHCSLGRPSRWFTASVQLQLCQDPAPSLLGPATL

SEQ ID NO: 29324 - protein, 144 aa, Homo sapiens
  Payload ID: 5721
  Gene Symbol: FAM101B
  Gene Name: family with sequence similarity 101, member B
  Uniprot ID: Q8N5W9
  ENSP ID: ENSP00000331915
SPASLPLAPGCALRLCPLSFGEGVEFDPLPPKEVRYTSLVKYDSERHFIDDVQLPLGLAVASCSQTVTCVPNGTWRNYKAEVRFEPRHRPTRFLSTTIVYPKYPKAVYTTTLDYNCRKTLRRFLSSVELEAAELPGSDDLSDEC

SEQ ID NO: 29325 - protein, 242 aa, Homo sapiens
  Payload ID: 5722
  Gene Symbol: FAM102A
  Gene Name: family with sequence similarity 102, member A
  Uniprot ID: Q5T9C2
  ENSP ID: ENSP00000362176
MFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 29326 - protein, 384 aa, Homo sapiens
  Payload ID: 5722
  Gene Symbol: FAM102A
  Gene Name: family with sequence similarity 102, member A
  Uniprot ID: Q5T9C2
  ENSP ID: ENSP00000362187
MAFLMKKKKFKFQTTFTLEELTAVPFVNGVLFCKVRLLDGGDFVSLSSREEVQENCVRWRKRFTFVCKMSANPATGLLDPCVFRVSVRKELKGGKAYSKLGFADLNLAEFAGSGSTVRCCLLEGYDTKNTRQDNSILKVTIGMFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 29327 - protein, 360 aa, Homo sapiens
  Payload ID: 5723
  Gene Symbol: FAM102B
  Gene Name: family with sequence similarity 102, member B
  Uniprot ID: Q5T8I3
  ENSP ID: ENSP00000359052
MMKKKKFKFKVDFELEELSSVPFVNGVLFCKMRLLDGGSFTAESSREVVQANCVRWRKKFSFMCKMSASAATGILDPCIYRVSVRKELKGGKAYAKLGFADLNLAEFAGSGNTTRRCLLEGYDTKNTRQDNSILKVLISMQLMSGDPCFKTPPSTSMSIPIAGESESLQEDRKGGETLKVHLGIADLSAKSASVPDELGACGHSRTSSYASQQSKVSGYSTCHSRSSSFSELCHRRNTSVGSTSTGVESILEPCDEIEQKIAEPNLDTADKEDTASEKLSRCPVKQDSVESQLKRVDDTRVDADDIVEKILQSQDFSLDSSAEEEGLRLFVGPGGSTTFGSHHLPNRVGSGAYEQVVIKR

SEQ ID NO: 29328 - protein, 355 aa, Homo sapiens
  Payload ID: 5723
  Gene Symbol: FAM102B
  Gene Name: family with sequence similarity 102, member B
  Uniprot ID: Q5T8I3
  ENSP ID: ENSP00000386084
MMKKKKFKFKVDFELEELSSVPFVNGVLFCKMRLLDGGSFTAESSREVVQANCVRWRKKFSFMCKMSASAATGILDPCIYRVSVRKELKGGKAYAKLGFADLNLAEFAGSGNTTRRCLLEGYDTKNTRQDNSILKVLISMQLMSGDPCFKTPPSTSMSIPIAGESESLQEDRKGGETLKVHLGIADLSAKSASVPDELGACGHSRTSSYASQQSKVSGYSTCHSRSSSFSELCHRRNTSVGSTSTGVESILEPCDEIEQKIAEPNLDTADKEDTASEKLSRCPVKQDSVESQLKRVDDTRVDADDIVEKILQSQDFSLDSSAEEEGLRLFVGPGGSTTFGSHHLPNSALEAPSLL

SEQ ID NO: 29329 - protein, 118 aa, Homo sapiens
  Payload ID: 5724
  Gene Symbol: FAM103A1
  Gene Name: family with sequence similarity 103, member A1
  Uniprot ID: Q9BTL3
  ENSP ID: ENSP00000307181
MTDTAEAVPKFEEMFASRFTENDKEYQEYLKRPPESPPIVEEWNSRAGGNQRNRGNRLQDNRQFRGRDNRWGWPSDNRSNQWHGRSWGNNYPQHRQEPYYPQQYGHYGYNQRPPYGYY

SEQ ID NO: 29330 - protein, 186 aa, Homo sapiens
  Payload ID: 5725
  Gene Symbol: FAM104A
  Gene Name: family with sequence similarity 104, member A
  Uniprot ID: Q969W3
  ENSP ID: ENSP00000384648
MGGRGADAGSSGGTGPTEGYSPPAASTRAAARAKARGGGRGGRRNTTPSVPSLRGAAPRSFHPPAAMSERLRPRKRRRNGNEEDNHLPPQTKRSSRNPVFQDSWDTESSGSDSGGSSSSSSSSINSPDRASGPEGSLSQTMAGSSPNTPQPVPEQSALCQGLYFHINQTLREAHFHSLQHRGRPLT

SEQ ID NO: 29331 - protein, 207 aa, Homo sapiens
  Payload ID: 5725
  Gene Symbol: FAM104A
  Gene Name: family with sequence similarity 104, member A
  Uniprot ID: Q969W3
  ENSP ID: ENSP00000384832
MGGRGADAGSSGGTGPTEGYSPPAASTRAAARAKARGGGRGGRRNTTPSVPSLRGAAPRSFHPPAAMSERLRPRKRRRNGNEEDNHLPPQTKRSSRNPVFQDSWDTETVPVMRNSKENRLRGNKAFCASSGSDSGGSSSSSSSSINSPDRASGPEGSLSQTMAGSSPNTPQPVPEQSALCQGLYFHINQTLREAHFHSLQHRGRPLT

SEQ ID NO: 29332 - protein, 109 aa, Homo sapiens
  Payload ID: 5725
  Gene Symbol: FAM104A
  Gene Name: family with sequence similarity 104, member A
  ENSP ID: ENSP00000462507
MGGRGADAGSSGGTGPTEGYSPPAASTRAAARAKARGGGRGGRRNTTPSVPSLRGAAPRSFHPPAAMSERLRPRIPGTQSLQAVTVVGAAAAAAAASIARTGPAGRKAA

SEQ ID NO: 29333 - protein, 96 aa, Homo sapiens
  Payload ID: 5725
  Gene Symbol: FAM104A
  Gene Name: family with sequence similarity 104, member A
  ENSP ID: ENSP00000462781
MRNSKENRLRGNKAFCASSGSDSGGSSSSSSSSINSPDRASGPEGSLSQTMAGSSPNTPQPVPEQSALCQGLYFHINQTLREAHFHSLQHRGRPLT

SEQ ID NO: 29334 - protein, 125 aa, Homo sapiens
  Payload ID: 5725
  Gene Symbol: FAM104A
  Gene Name: family with sequence similarity 104, member A
  ENSP ID: ENSP00000462806
MEGSTIRKRRRNGNEEDNHLPPQTKRSSRNPVFQDSWDTETVPVMRNSKENRLRGNKAFCASSGSDSGGSSSSSSSSINSPDRASGPEGSLSQTMAGSSPNTPQPVPEQSALCQGLYFHINQTLR

SEQ ID NO: 29335 - protein, 103 aa, Homo sapiens
  Payload ID: 5725
  Gene Symbol: FAM104A
  Gene Name: family with sequence similarity 104, member A
  ENSP ID: ENSP00000462840
MGGRGADAGSSGGTGPTEGYSPPAASTRAAARAKARGGGRGGRRNTTPSVPSLRGAAPRSFHPPAAMSERLRPSLQAVTVVGAAAAAAAASIARTGPAGRKAA

SEQ ID NO: 29336 - protein, 116 aa, Homo sapiens
  Payload ID: 5726
  Gene Symbol: FAM104B
  Gene Name: family with sequence similarity 104, member B
  Uniprot ID: Q5XKR9
  ENSP ID: ENSP00000333394
MGGCPVRKRRRNGSKEGNHHSTQPKRNKRNPIFQDSQDTEVFSWSDNERSSSRINIPERASGPEGNLNQIVTEPDANFPQFLHEGLSKPVYVINWFMSFGPEIKLNTSQQGRNQAV

SEQ ID NO: 29337 - protein, 115 aa, Homo sapiens
  Payload ID: 5726
  Gene Symbol: FAM104B
  Gene Name: family with sequence similarity 104, member B
  Uniprot ID: Q5XKR9
  ENSP ID: ENSP00000364101
MGGCPVRKRRRNGSKEGNHHSTQPKRNKRNPIFQDSQDTEFSWSDNERSSSRINIPERASGPEGNLNQIVTEPDANFPQFLHEGLSKPVYVINWFMSFGPEIKLNTSQQGRNQAV

SEQ ID NO: 29338 - protein, 116 aa, Homo sapiens
  Payload ID: 5726
  Gene Symbol: FAM104B
  Gene Name: family with sequence similarity 104, member B
  Uniprot ID: Q5XKR9
  ENSP ID: ENSP00000397188
MGGCPVRKRRRNGSKEGNHHSTQPKRNKRNPIFQDSQDTEVFSWSDNERSSSRINIPERASGPEGNLNQIVTEPDANFPQFLHEGYVPCQGLYSHINQTLKEAHFNSLQQRGQAPT

SEQ ID NO: 29339 - protein, 46 aa, Homo sapiens
  Payload ID: 5726
  Gene Symbol: FAM104B
  Gene Name: family with sequence similarity 104, member B
  Uniprot ID: Q5XKR9
  ENSP ID: ENSP00000420895
MGGCPVRKRRRNGSKEGNHHSTQPKRNKRNPIFQDSQDTEVAIFME

SEQ ID NO: 29340 - protein, 112 aa, Homo sapiens
  Payload ID: 5726
  Gene Symbol: FAM104B
  Gene Name: family with sequence similarity 104, member B
  Uniprot ID: Q5XKR9
  ENSP ID: ENSP00000421161
MTCRKRRRNGSKEGNHHSTQPKRNKRNPIFQDSQDTEFSWSDNERSSSRINIPERASGPEGNLNQIVTEPDANFPQFLHEGYVPCQGLYSHINQTLKEAHFNSLQQRGQAPT

SEQ ID NO: 29341 - protein, 114 aa, Homo sapiens
  Payload ID: 5726
  Gene Symbol: FAM104B
  Gene Name: family with sequence similarity 104, member B
  Uniprot ID: Q5XKR9
  ENSP ID: ENSP00000423164
MLVLWLKRRRNGSKEGNHHSTQPKRNKRNPIFQDSQDTEFSWSDNERSSSRINIPERASGPEGNLNQIVTEPDANFPQFLHEGYVPCQGLYSHINQTLKEAHFNSLQQRGQAPT

SEQ ID NO: 29342 - protein, 356 aa, Homo sapiens
  Payload ID: 5727
  Gene Symbol: FAM105A
  Gene Name: family with sequence similarity 105, member A
  Uniprot ID: Q9NUU6
  ENSP ID: ENSP00000274217
MAATRSPTRARERERSGAPAAGSDQVHSWMLATSQALDTVWRMAKGFVMLAVSFLVAAICYFRRLHLYSGHKLKWWIGYLQRKFKRNLSVEAEVDLLSYCAREWKGETPRNKLMRKAYEELFWRHHIKCVRQVRRDNYDALRSVLFQIFSQGISFPSWMKEKDIVKLPEKLLFSQGCNWIQQYSFGPEKYTGSNVFGKLRKYVELLKTQWTEFNGIRDYHKRGSMCNTLFSDAILEYKLYEALKFIMLYQVTEVYEQMKTKKVIPSLFRLLFSRETSSDPLSFMMNHLNSVGDTCGLEQIDMFILGYSLEVKIKVFRLFKFNSRDFEVCYPEEPLRDWPEISLLTENDRHYHIPVF

SEQ ID NO: 29343 - protein, 169 aa, Homo sapiens
  Payload ID: 5728
  Gene Symbol: FAM106A
  Gene Name: family with sequence similarity 106, member A
  Uniprot ID: Q4KMX7
  ENSP ID: ENSP00000437812
MLPSTMFLVHLPLSTNRLHCLRNTSLESYLCSFVHLNHPLHISDRVILISLHEAVRFSFAFSFPRGTLSIAYCLMSSVSTSSEAIMSTELLANYCHSSLHVCICISSFPNETGNHDSFPGAVVSISDQPTDQCKLAAKELPLRNLLECRFFDCMGEEDLINLGVIGTER

SEQ ID NO: 29344 - protein, 144 aa, Homo sapiens
  Payload ID: 5729
  Gene Symbol: FAM107A
  Gene Name: family with sequence similarity 107, member A
  Uniprot ID: O95990
  ENSP ID: ENSP00000354270
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 29345 - protein, 144 aa, Homo sapiens; identical to SEQ ID NO: 29344
  Payload ID: 5729
  Gene Symbol: FAM107A
  Gene Name: family with sequence similarity 107, member A
  Uniprot ID: O95990
  ENSP ID: ENSP00000377991

SEQ ID NO: 29346 - protein, 172 aa, Homo sapiens
  Payload ID: 5729
  Gene Symbol: FAM107A
  Gene Name: family with sequence similarity 107, member A
  Uniprot ID: O95990
  ENSP ID: ENSP00000400858
MAQRLGEWARGPSDATGLYRAVLLRSAAMYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 29347 - protein, 105 aa, Homo sapiens
  Payload ID: 5729
  Gene Symbol: FAM107A
  Gene Name: family with sequence similarity 107, member A
  ENSP ID: ENSP00000418038
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQ

SEQ ID NO: 29348 - protein, 175 aa, Homo sapiens
  Payload ID: 5729
  Gene Symbol: FAM107A
  Gene Name: family with sequence similarity 107, member A
  Uniprot ID: O95990
  ENSP ID: ENSP00000419124
MGAAQGKKKTYSPQARFHSENEKQRRNGSAAMYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 29349 - protein, 135 aa, Homo sapiens
  Payload ID: 5729
  Gene Symbol: FAM107A
  Gene Name: family with sequence similarity 107, member A
  Uniprot ID: O95990
  ENSP ID: ENSP00000419529
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQVGDGHPAGTTHPPGLSSREELCCGHS

SEQ ID NO: 29350 - protein, 306 aa, Homo sapiens
  Payload ID: 5730
  Gene Symbol: FAM107B
  Gene Name: family with sequence similarity 107, member B
  Uniprot ID: Q9H098
  ENSP ID: ENSP00000181796
MSTWKARLTKRLKSPSRSMHPFPCSALLACFGNTRESASFNQSGVADTHSTVRVQPVAKAGRQPRHPSAEGAPEKRQDSSTHAERNGSANRNSSHRTAAQPAETPEDVPGSLDDGADCEAVVFHASIPRPSIIDTPKEEEFREEPKCLELEQKMTSDSPPEDIDHKDSYLITRSIMAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 29351 - protein, 131 aa, Homo sapiens
  Payload ID: 5730
  Gene Symbol: FAM107B
  Gene Name: family with sequence similarity 107, member B
  Uniprot ID: Q9H098
  ENSP ID: ENSP00000367719
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 29352 - protein, 131 aa, Homo sapiens; identical to SEQ ID NO: 29351
  Payload ID: 5730
  Gene Symbol: FAM107B
  Gene Name: family with sequence similarity 107, member B
  Uniprot ID: Q9H098
  ENSP ID: ENSP00000367723

SEQ ID NO: 29353 - protein, 131 aa, Homo sapiens; identical to SEQ ID NO: 29351
  Payload ID: 5730
  Gene Symbol: FAM107B
  Gene Name: family with sequence similarity 107, member B
  Uniprot ID: Q9H098
  ENSP ID: ENSP00000367726

SEQ ID NO: 29354 - protein, 131 aa, Homo sapiens; identical to SEQ ID NO: 29351
  Payload ID: 5730
  Gene Symbol: FAM107B
  Gene Name: family with sequence similarity 107, member B
  Uniprot ID: Q9H098
  ENSP ID: ENSP00000367728

SEQ ID NO: 29355 - protein, 131 aa, Homo sapiens; identical to SEQ ID NO: 29351
  Payload ID: 5730
  Gene Symbol: FAM107B
  Gene Name: family with sequence similarity 107, member B
  Uniprot ID: Q9H098
  ENSP ID: ENSP00000367731

SEQ ID NO: 29356 - protein, 90 aa, Homo sapiens
  Payload ID: 5730
  Gene Symbol: FAM107B
  Gene Name: family with sequence similarity 107, member B
  ENSP ID: ENSP00000397949
MAEPDYIEDDNPELIRPQKLINPVKTSRNHQDLHRELLMNQKRGLAPQNKPELQKVMEKRKRDQVIKQKEEEAQKKKSDLEIELLKRQQK

SEQ ID NO: 29357 - protein, 128 aa, Homo sapiens
  Payload ID: 5730
  Gene Symbol: FAM107B
  Gene Name: family with sequence similarity 107, member B
  ENSP ID: ENSP00000413676
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQA

SEQ ID NO: 29358 - protein, 101 aa, Homo sapiens
  Payload ID: 5730
  Gene Symbol: FAM107B
  Gene Name: family with sequence similarity 107, member B
  ENSP ID: ENSP00000417242
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKL

SEQ ID NO: 29359 - protein, 131 aa, Homo sapiens; identical to SEQ ID NO: 29351
  Payload ID: 5730
  Gene Symbol: FAM107B
  Gene Name: family with sequence similarity 107, member B
  Uniprot ID: Q9H098
  ENSP ID: ENSP00000417782

SEQ ID NO: 29360 - protein, 84 aa, Homo sapiens
  Payload ID: 5730
  Gene Symbol: FAM107B
  Gene Name: family with sequence similarity 107, member B
  ENSP ID: ENSP00000417845
MAEPDYIEDDNPELIRPQKLINPVKTSRNHQDLHRELLMNQKRGLAPQNKPELQKVMEKRKRDQVIKQKEEEAQKKKSDLEIEL

SEQ ID NO: 29361 - protein, 131 aa, Homo sapiens; identical to SEQ ID NO: 29351
  Payload ID: 5730
  Gene Symbol: FAM107B
  Gene Name: family with sequence similarity 107, member B
  Uniprot ID: Q9H098
  ENSP ID: ENSP00000418120

SEQ ID NO: 29362 - protein, 131 aa, Homo sapiens; identical to SEQ ID NO: 29351
  Payload ID: 5730
  Gene Symbol: FAM107B
  Gene Name: family with sequence similarity 107, member B
  Uniprot ID: Q9H098
  ENSP ID: ENSP00000418330

SEQ ID NO: 29363 - protein, 51 aa, Homo sapiens
  Payload ID: 5730
  Gene Symbol: FAM107B
  Gene Name: family with sequence similarity 107, member B
  ENSP ID: ENSP00000418365
MAEPDYIEDDNPELIRPQKLINPVKTSRNHQDLHRELLMNQKRILVWLEIH

SEQ ID NO: 29364 - protein, 124 aa, Homo sapiens
  Payload ID: 5730
  Gene Symbol: FAM107B
  Gene Name: family with sequence similarity 107, member B
  ENSP ID: ENSP00000418395
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQE

SEQ ID NO: 29365 - protein, 67 aa, Homo sapiens
  Payload ID: 5730
  Gene Symbol: FAM107B
  Gene Name: family with sequence similarity 107, member B
  ENSP ID: ENSP00000419064
MAEPDYIEDDNPELIRPQKLINPVKTSRNHQDLHRELLMNQKRGLAPQNKPELQKVMEKRKRDQVIK

SEQ ID NO: 29366 - protein, 131 aa, Homo sapiens; identical to SEQ ID NO: 29351
  Payload ID: 5730
  Gene Symbol: FAM107B
  Gene Name: family with sequence similarity 107, member B
  Uniprot ID: Q9H098
  ENSP ID: ENSP00000419603

SEQ ID NO: 29367 - protein, 126 aa, Homo sapiens
  Payload ID: 5730
  Gene Symbol: FAM107B
  Gene Name: family with sequence similarity 107, member B
  ENSP ID: ENSP00000420249
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVA

SEQ ID NO: 29368 - protein, 160 aa, Homo sapiens
  Payload ID: 5730
  Gene Symbol: FAM107B
  Gene Name: family with sequence similarity 107, member B
  ENSP ID: ENSP00000420273
MSTWKARLTKRLKSPSRSMHPFPCSALLACFGNTRESASFNQSGVADTHSTVRVQPVAKAGRQPRHPSAEGAPEKRQDSSTHAERNGSANRNSSHRTAAQPAETPEDVPGSLDDGADCEAVVFHASIPRPSIIDTPKEEEFREEPKCLELEQKMTSGECS

SEQ ID NO: 29369 - protein, 93 aa, Homo sapiens
  Payload ID: 5730
  Gene Symbol: FAM107B
  Gene Name: family with sequence similarity 107, member B
  ENSP ID: ENSP00000420314
MAEPDYIEDDNPELIRPQKLINPVKTSRNHQDLHRELLMNQKRGLAPQNKPELQKVMEKRKRDQVIKQKEEEAQKKKSDLEIELLKRQQKLEQ

SEQ ID NO: 29370 - protein, 130 aa, Homo sapiens
  Payload ID: 5730
  Gene Symbol: FAM107B
  Gene Name: family with sequence similarity 107, member B
  ENSP ID: ENSP00000420444
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQE

SEQ ID NO: 29371 - protein, 131 aa, Homo sapiens; identical to SEQ ID NO: 29351
  Payload ID: 5730
  Gene Symbol: FAM107B
  Gene Name: family with sequence similarity 107, member B
  Uniprot ID: Q9H098
  ENSP ID: ENSP00000479842

SEQ ID NO: 29372 - protein, 262 aa, Homo sapiens
  Payload ID: 5731
  Gene Symbol: FAM109A
  Gene Name: family with sequence similarity 109, member A
  Uniprot ID: Q8N4B1
  ENSP ID: ENSP00000354461
MAPGSPPGPAIATMKLNERSLAFYATCDAPVDNAGFLYKKGGRHAAYHRRWFVLRGNMLFYFEDAASREPVGVIILEGCTVELVEAAEEFAFAVRFAGTRARTYVLAAESQDAMEGWVKALSRASFDYLRLVVRELEQQLAAVRGGGGMALPQPQPQSLPLPPSLPSALAPVPSLPSAPAPVPALPLPRRPSALPPKENGCAVWSTEATFRPGPEPPPPPPRRRASAPHGPLDMAPFARLHECYGQEIRALRGQWLSSRVQP

SEQ ID NO: 29373 - protein, 117 aa, Homo sapiens
  Payload ID: 5731
  Gene Symbol: FAM109A
  Gene Name: family with sequence similarity 109, member A
  ENSP ID: ENSP00000447349
MKLNERSLAFYATCDAPVDNAGFLYKKGGRHAAYHRRWFVLRGNMLFYFEDAASREPVGVIILEGCTVELVEAAEEFAFAVRFAGTRARTYVLAAESQDAMEGWVKALSRASFDYLR

SEQ ID NO: 29374 - protein, 249 aa, Homo sapiens
  Payload ID: 5731
  Gene Symbol: FAM109A
  Gene Name: family with sequence similarity 109, member A
  Uniprot ID: Q8N4B1
  ENSP ID: ENSP00000447353
MKLNERSLAFYATCDAPVDNAGFLYKKGGRHAAYHRRWFVLRGNMLFYFEDAASREPVGVIILEGCTVELVEAAEEFAFAVRFAGTRARTYVLAAESQDAMEGWVKALSRASFDYLRLVVRELEQQLAAVRGGGGMALPQPQPQSLPLPPSLPSALAPVPSLPSAPAPVPALPLPRRPSALPPKENGCAVWSTEATFRPGPEPPPPPPRRRASAPHGPLDMAPFARLHECYGQEIRALRGQWLSSRVQP

SEQ ID NO: 29375 - protein, 74 aa, Homo sapiens
  Payload ID: 5731
  Gene Symbol: FAM109A
  Gene Name: family with sequence similarity 109, member A
  ENSP ID: ENSP00000447539
MKLNERSLAFYATCDAPVDNAGFLYKKGGRHAAYHRRWFVLRGNMLFYFEDAASREPVGVIILEGCTVELVEAA

SEQ ID NO: 29376 - protein, 249 aa, Homo sapiens; identical to SEQ ID NO: 29374
  Payload ID: 5731
  Gene Symbol: FAM109A
  Gene Name: family with sequence similarity 109, member A
  Uniprot ID: Q8N4B1
  ENSP ID: ENSP00000449994

SEQ ID NO: 29377 - protein, 259 aa, Homo sapiens
  Payload ID: 5732
  Gene Symbol: FAM109B
  Gene Name: family with sequence similarity 109, member B
  Uniprot ID: Q6ICB4
  ENSP ID: ENSP00000312753
MKLNERSVAHYALSDSPADHMGFLRTWGGPGTPPTPSGTGRRCWFVLKGNLLFSFESREGRAPLSLVVLEGCTVELAEAPVPEEFAFAICFDAPGVRPHLLAAEGPAAQEAWVKVLSRASFGYMRLVVRELESQLQDARQSLALQRRSSWKSVASRCKPQAPNHRAAGLENGHCLSKDSSPVGLVEEAGSRSAGWGLAEWELQGPASLLLGKGQSPVSPETSCFSTLHDWYGQEIVELRQCWQKRAQGSHSKCEEQDRP

SEQ ID NO: 29378 - protein, 108 aa, Homo sapiens
  Payload ID: 5732
  Gene Symbol: FAM109B
  Gene Name: family with sequence similarity 109, member B
  ENSP ID: ENSP00000396170
MKLNERSVAHYALSDSPADHMGFLRTWGGPGTPPTPSGTGRRCWFVLKGNLLFSFESREGRAPLSLVVLEGCTVELAEAPVPEEFAFAICFDAPGVRPHLLAAEGPAA

SEQ ID NO: 29379 - protein, 295 aa, Homo sapiens
  Payload ID: 5733
  Gene Symbol: FAM110A
  Gene Name: family with sequence similarity 110, member A
  Uniprot ID: Q9BQ89
  ENSP ID: ENSP00000246100
MPVHTLSPGAPSAPALPCRLRTRVPGYLLRGPADGGARKPSAVERLEADKAKYVKSLHVANTRQEPVQPLLSKQPLFSPETRRTVLTPSRRALPGPCRRPQLDLDILSSLIDLCDSPVSPAEASRTPGRAEGAGRPPPATPPRPPPSTSAVRRVDVRPLPASPARPCPSPGPAAASSPARPPGLQRSKSDLSERFSRAAADLERFFNFCGLDPEEARGLGVAHLARASSDIVSLAGPSAGPGSSEGGCSRRSSVTVEERARERVPYGVSVVERNARVIKWLYGLRQARESPAAEG

SEQ ID NO: 29380 - protein, 295 aa, Homo sapiens; identical to SEQ ID NO: 29379
  Payload ID: 5733
  Gene Symbol: FAM110A
  Gene Name: family with sequence similarity 110, member A
  Uniprot ID: Q9BQ89
  ENSP ID: ENSP00000354163

SEQ ID NO: 29381 - protein, 295 aa, Homo sapiens; identical to SEQ ID NO: 29379
  Payload ID: 5733
  Gene Symbol: FAM110A
  Gene Name: family with sequence similarity 110, member A
  Uniprot ID: Q9BQ89
  ENSP ID: ENSP00000371365

SEQ ID NO: 29382 - protein, 295 aa, Homo sapiens; identical to SEQ ID NO: 29379
  Payload ID: 5733
  Gene Symbol: FAM110A
  Gene Name: family with sequence similarity 110, member A
  Uniprot ID: Q9BQ89
  ENSP ID: ENSP00000371367

SEQ ID NO: 29383 - protein, 295 aa, Homo sapiens; identical to SEQ ID NO: 29379
  Payload ID: 5733
  Gene Symbol: FAM110A
  Gene Name: family with sequence similarity 110, member A
  Uniprot ID: Q9BQ89
  ENSP ID: ENSP00000445228

SEQ ID NO: 29384 - protein, 189 aa, Homo sapiens
  Payload ID: 5733
  Gene Symbol: FAM110A
  Gene Name: family with sequence similarity 110, member A
  ENSP ID: ENSP00000477334
  MOD_RES (1)..(1): Any amino acid
XSSLIDLCDSPVSPAEASRTPGRAEGAGRPPPATPPRPPPSTSAVRRVDVRPLPASPARPCPSPGPAAASSPARPPGLQRSKSDLSERFSRAAADLERFFNFCGLDPEEARGLGVAHLARASSDIVSLAGPSAGPGSSEGGCSRRSSVTVEERARERVPYGVSVVERNARVIKWLYGLRQARESPAAEG

SEQ ID NO: 29385 - protein, 370 aa, Homo sapiens
  Payload ID: 5734
  Gene Symbol: FAM110B
  Gene Name: family with sequence similarity 110, member B
  Uniprot ID: Q8TC76
  ENSP ID: ENSP00000355204
MPTETLQTGSMVKPVSPAGTFTSAVPLRILNKGPDYFRRQAEPNPKRLSAVERLEADKAKYVKSQEVINAKQEPVKPAVLAKPPVCPAAKRALGSPTLKVFGNHAKTESGVQRENLKLEILKNIINSSEGSSSGSGHKHSSRNWPPHRSEATDLHRHSFAESLKVYPTQGRRSPQEGGSHVGRRLLEQSAESFLHVSHSSSDIRKVTSVKPLKAIPCSSSAPPLPPKPKIAAIASMKSPEADPVEPACGVSRRPSLQRSKSDLSDRYFRVDADVERFFNYCGLDPEELENLGMENFARANSDIISLNFRSASMISSDCEQSQDSNSDLRNDDSANDRVPYGISAIERNARIIKWLYSIKQARESQKVSHV

SEQ ID NO: 29386 - protein, 321 aa, Homo sapiens
  Payload ID: 5735
  Gene Symbol: FAM110C
  Gene Name: family with sequence similarity 110, member C
  Uniprot ID: Q1W6H9
  ENSP ID: ENSP00000328347
MRALAALSAPPNERLLPRDPAATRDPDAARPARRSAVERLAADRAKYVRGRPGTGRGVASEGSGPGAIKCPGNDPGPPARAPAPVARRAIARKPLRPDSLIIYRQKCEFVRGSGADGPRASLVKKLFQGPGKDKAPVPRTGDEGKAGNPETVPTTPGPAADPAIPETPAPAARSAAPSSVPAAPPGPEPRVVRRRGLQRSQSDLSSRYSAALAESDTFFQYCGLDPEVVEALGRENFTAGSDCVTLKVRSVSVATSGSGFSRHSGGDDEGLQEEELIEQVPSTTSVIERNARIIKWLYTCKKAKETPSQEQSRTRGSKPSR

SEQ ID NO: 29387 - protein, 271 aa, Homo sapiens
  Payload ID: 5736
  Gene Symbol: FAM110D
  Gene Name: family with sequence similarity 110, member D
  Uniprot ID: Q8TAY7
  ENSP ID: ENSP00000363386
MLLAPPSTPSRGRTPSAVERLEADKAKYVKTHQVIARRQEPALRGSPGPLTPHPCNELGPPASPRTPRPVRRGSGRRLPRPDSLIFYRQKRDCKASVNKENAKGQGLVRRLFLGAPRDAAPSSPASTERPAASGGWAAPQDAPEAAGKRALCPTCSLPLSEKERFFNYCGLERALVEVLGAERFSPQSWGADASPQAGTSPPPGSGDASDWTSSDRGVDSPGGAGGGGGSEAAGSARDRRPPVSVVERNARVIQWLYGCQRARGPPRESEV

SEQ ID NO: 29388 - protein, 611 aa, Homo sapiens
  Payload ID: 5737
  Gene Symbol: FAM111A
  Gene Name: family with sequence similarity 111, member A
  Uniprot ID: Q96PZ2
  ENSP ID: ENSP00000355264
MSCKKQRSRKHSVNEKCNMKIEHYFSPVSKEQQNNCSTSLMRMESRGDPRATTNTQAQRFHSPKKNPEDQTMPQNRTIYVTLKVNHRRNQDMKLKLTHSENSSLYMALNTLQAVRKEIETHQGQEMLVRGTEGIKEYINLGMPLSCFPEGGQVVITFSQSKSKQKEDNHIFGRQDKASTECVKFYIHAIGIGKCKRRIVKCGKLHKKGRKLCVYAFKGETIKDALCKDGRFLSFLENDDWKLIENNDTILESTQPVDELEGRYFQVEVEKRMVPSAAASQNPESEKRNTCVLREQIVAQYPSLKRESEKIIENFKKKMKVKNGETLFELHRTTFGKVTKNSSSIKVVKLLVRLSDSVGYLFWDSATTGYATCFVFKGLFILTCRHVIDSIVGDGIEPSKWATIIGQCVRVTFGYEELKDKETNYFFVEPWFEIHNEELDYAVLKLKENGQQVPMELYNGITPVPLSGLIHIIGHPYGEKKQIDACAVIPQGQRAKKCQERVQSKKAESPEYVHMYTQRSFQKIVHNPDVITYDTEFFFGASGSPVFDSKGSLVAMHAAGFAYTYQNETRSIIEFGSTMESILLDIKQRHKPWYEEVFVNQQDVEMMSDEDL

SEQ ID NO: 29389 - protein, 611 aa, Homo sapiens; identical to SEQ ID NO: 29388
  Payload ID: 5737
  Gene Symbol: FAM111A
  Gene Name: family with sequence similarity 111, member A
  Uniprot ID: Q96PZ2
  ENSP ID: ENSP00000406683

SEQ ID NO: 29390 - protein, 611 aa, Homo sapiens; identical to SEQ ID NO: 29388
  Payload ID: 5737
  Gene Symbol: FAM111A
  Gene Name: family with sequence similarity 111, member A
  Uniprot ID: Q96PZ2
  ENSP ID: ENSP00000431631

SEQ ID NO: 29391 - protein, 96 aa, Homo sapiens
  Payload ID: 5737
  Gene Symbol: FAM111A
  Gene Name: family with sequence similarity 111, member A
  ENSP ID: ENSP00000432821
MSCKKQRSRKHSVNEKCNMKIEHYFSPVSKEQQNNCSTSLMRMESRGDPRATTNTQAQRFHSPKKNPEDQTMPQNRTIYVTLKVNHRRNQDMKLKL

SEQ ID NO: 29392 - protein, 611 aa, Homo sapiens; identical to SEQ ID NO: 29388
  Payload ID: 5737
  Gene Symbol: FAM111A
  Gene Name: family with sequence similarity 111, member A
  Uniprot ID: Q96PZ2
  ENSP ID: ENSP00000433154

SEQ ID NO: 29393 - protein, 611 aa, Homo sapiens; identical to SEQ ID NO: 29388
  Payload ID: 5737
  Gene Symbol: FAM111A
  Gene Name: family with sequence similarity 111, member A
  Uniprot ID: Q96PZ2
  ENSP ID: ENSP00000434435

SEQ ID NO: 29394 - protein, 183 aa, Homo sapiens
  Payload ID: 5737
  Gene Symbol: FAM111A
  Gene Name: family with sequence similarity 111, member A
  ENSP ID: ENSP00000436128
MSCKKQRSRKHSVNEKCNMKIEHYFSPVSKEQQNNCSTSLMRMESRGDPRATTNTQAQRFHSPKKNPEDQTMPQNRTIYVTLKVNHRRNQDMKLKLTHSENSSLYMALNTLQAVRKEIETHQGQEMLVRGTEGIKEYINLGMPLSCFPEGGQVVITFSQSKSKQKEDNHIFGRQDKASTECVK

SEQ ID NO: 29395 - protein, 734 aa, Homo sapiens
  Payload ID: 5738
  Gene Symbol: FAM111B
  Gene Name: family with sequence similarity 111, member B
  Uniprot ID: Q6SJ93
  ENSP ID: ENSP00000341565
MNSMKTEENKSFSAMEDDQRTRPEVSKDTVMKQTHADTPVDHCLSGIRKCSSTFKLKSEVNKHETALEMQNPNLNNKECCFTFTLNGNSRKLDRSVFTAYGKPSESIYSALSANDYFSERIKNQFNKNIIVYEEKTIDGHINLGMPLKCLPSDSHFKITFGQRKSSKEDGHILRQCENPNMECILFHVVAIGRTRKKIVKINELHEKGSKLCIYALKGETIEGALCKDGRFRSDIGEFEWKLKEGHKKIYGKQSMVDEVSGKVLEMDISKKKALQQKDIHKKIKQNESATDEINHQSLIQSKKKVHKPKKDGETKDVEHSREQILPPQDLSHYIKDKTRQTIPRIRNYYFCSLPRKYRQINSQVRRRPHLGRRYAINLDVQKEAINLLKNYQTLNEAIMHQYPNFKEEAQWVRKYFREEQKRMNLSPAKQFNIYKKDFGKMTANSVSVATCEQLTYYSKSVGFMQWDNNGNTGNATCFVFNGGYIFTCRHVVHLMVGKNTHPSLWPDIISKCAKVTFTYTEFCPTPDNWFSIEPWLKVSNENLDYAILKLKENGNAFPPGLWRQISPQPSTGLIYLIGHPEGQIKKIDGCTVIPLNERLKKYPNDCQDGLVDLYDTTSNVYCMFTQRSFLSEVWNTHTLSYDTCFSDGSSGSPVFNASGKLVALHTFGLFYQRGFNVHALIEFGYSMDSILCDIKKTNESLYKSLNDEKLETYDEEKGKQESSLQDHQIEPMEC

SEQ ID NO: 29396 - protein, 704 aa, Homo sapiens
  Payload ID: 5738
  Gene Symbol: FAM111B
  Gene Name: family with sequence similarity 111, member B
  Uniprot ID: Q6SJ93
  ENSP ID: ENSP00000393855
MKQTHADTPVDHCLSGIRKCSSTFKLKSEVNKHETALEMQNPNLNNKECCFTFTLNGNSRKLDRSVFTAYGKPSESIYSALSANDYFSERIKNQFNKNIIVYEEKTIDGHINLGMPLKCLPSDSHFKITFGQRKSSKEDGHILRQCENPNMECILFHVVAIGRTRKKIVKINELHEKGSKLCIYALKGETIEGALCKDGRFRSDIGEFEWKLKEGHKKIYGKQSMVDEVSGKVLEMDISKKKALQQKDIHKKIKQNESATDEINHQSLIQSKKKVHKPKKDGETKDVEHSREQILPPQDLSHYIKDKTRQTIPRIRNYYFCSLPRKYRQINSQVRRRPHLGRRYAINLDVQKEAINLLKNYQTLNEAIMHQYPNFKEEAQWVRKYFREEQKRMNLSPAKQFNIYKKDFGKMTANSVSVATCEQLTYYSKSVGFMQWDNNGNTGNATCFVFNGGYIFTCRHVVHLMVGKNTHPSLWPDIISKCAKVTFTYTEFCPTPDNWFSIEPWLKVSNENLDYAILKLKENGNAFPPGLWRQISPQPSTGLIYLIGHPEGQIKKIDGCTVIPLNERLKKYPNDCQDGLVDLYDTTSNVYCMFTQRSFLSEVWNTHTLSYDTCFSDGSSGSPVFNASGKLVALHTFGLFYQRGFNVHALIEFGYSMDSILCDIKKTNESLYKSLNDEKLETYDEEKGKQESSLQDHQIEPMEC

SEQ ID NO: 29397 - protein, 162 aa, Homo sapiens
  Payload ID: 5738
  Gene Symbol: FAM111B
  Gene Name: family with sequence similarity 111, member B
  ENSP ID: ENSP00000432143
MKQTHADTPVDHCLSGIRKCSSTFKLKSEVNKHETALEMQNPNLNNKECCFTFTLNGNSRKLDRSVFTAYGKPSESIYSALSANDYFSERIKNQFNKNIIVYEEKTIDGHINLGMPLKCLPSDSHFKITFGQRKSSKEDGHILRQCENPNMECILFHVVAIG

SEQ ID NO: 29398 - protein, 704 aa, Homo sapiens; identical to SEQ ID NO: 29396
  Payload ID: 5738
  Gene Symbol: FAM111B
  Gene Name: family with sequence similarity 111, member B
  Uniprot ID: Q6SJ93
  ENSP ID: ENSP00000432875

SEQ ID NO: 29399 - protein, 734 aa, Homo sapiens; identical to SEQ ID NO: 29395
  Payload ID: 5738
  Gene Symbol: FAM111B
  Gene Name: family with sequence similarity 111, member B
  Uniprot ID: Q6SJ93
  ENSP ID: ENSP00000483456

SEQ ID NO: 29400 - protein, 563 aa, Homo sapiens
  Payload ID: 5739
  Gene Symbol: FAM114A1
  Gene Name: family with sequence similarity 114, member A1
  Uniprot ID: Q8IWE2
  ENSP ID: ENSP00000351740
MSDDAGDTLATGDKAEVTEMPNSDSLPEDAEVHCDSAAVSHEPTPADPRGEGHENAAVQGAGAAAIGPPVQPQDANALEPPLNGDVTEDTLAECIDSVSLEAEPRSEIPLQEQNYLAVDSPPSGGGWAGWGSWGKSLLSSASATVGHGLTAVKEKAGATLRIHGVNSGSSEGAQPNTENGVPEITDAATDQGPAESPPTSPSSASRGMLSAITNVVQNTGKSVLTGGLDALEFIGKKTMNVLAESDPGFKRTKTLMERTVSLSQMLREAKEKEKQRLAQQLTMERTAHYGMLFDEYQGLSHLEALEILSNESESKVQSFLASLDGEKLELLKNDLISIKDIFAAKELENEENQEEQGLEEKGEEFARMLTELLFELHVAATPDKLNKAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGSNKKAEVLNPMISSVLLEGCNSTTYIQDAFQLLLPVLQVSHIQTSCLKAQP

SEQ ID NO: 29401 - protein, 133 aa, Homo sapiens
  Payload ID: 5739
  Gene Symbol: FAM114A1
  Gene Name: family with sequence similarity 114, member A1
  ENSP ID: ENSP00000422965
MSDDAGDTLATGDKAEVTEMPNSDSLPEDAEVHCDSAAVSHEPTPADPRGEGHENAAVQGAGAAAIGPPVQPQDANALEPPLNGDVTEDTLAECIDSVSLEAEPRSEIPLQEQNYLAVDSPPSGGGWAGWGSW

SEQ ID NO: 29402 - protein, 356 aa, Homo sapiens
  Payload ID: 5739
  Gene Symbol: FAM114A1
  Gene Name: family with sequence similarity 114, member A1
  Uniprot ID: Q8IWE2
  ENSP ID: ENSP00000424115
MLSAITNVVQNTGKSVLTGGLDALEFIGKKTMNVLAESDPGFKRTKTLMERTVSLSQMLREAKEKEKQRLAQQLTMERTAHYGMLFDEYQGLSHLEALEILSNESESKVQSFLASLDGEKLELLKNDLISIKDIFAAKELENEENQEEQGLEEKGEEFARMLTELLFELHVAATPDKLNKAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGSNKKAEVLNPMISSVLLEGCNSTTYIQDAFQLLLPVLQVSHIQTSCLKAQP

SEQ ID NO: 29403 - protein, 505 aa, Homo sapiens
  Payload ID: 5740
  Gene Symbol: FAM114A2
  Gene Name: family with sequence similarity 114, member A2
  Uniprot ID: Q9NRY5
  ENSP ID: ENSP00000341597
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPGPSEISTEVKYVAGETNAKENENSSPVAGAFGVFSTISTAVQSTGKSVISGGLDALEFIGKKTMDVIAEGDPGFKRTKGLMNRNATLSQVLREAKEKEEIRTSNEVTVETDKKTHYGLLFDEFQGLSHLEALEMLSQESEIKVKSILNSLSGEELETLKVELEQLKETFSLAEFCEEEEEEKKGDEDFTKDITELFSQLHVSSKPEKLARARNTAHEWIRKSLTKPLAENEEGEKQSEAENTEQVNKNSIEDIHAFAIRSLAELTACSIELFHKTAALVLHGRKQEVTAIERSQTLSQMTIVLCKELSSLSKEFTTCLTTAGVKEMADVLNPLITAVFLEASNSASYIQDAFQLLLPVLEISLIENKIESHRHELQGQKPLLEH

SEQ ID NO: 29404 - protein, 103 aa, Homo sapiens
  Payload ID: 5740
  Gene Symbol: FAM114A2
  Gene Name: family with sequence similarity 114, member A2
  ENSP ID: ENSP00000428551
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATV

SEQ ID NO: 29405 - protein, 166 aa, Homo sapiens
  Payload ID: 5740
  Gene Symbol: FAM114A2
  Gene Name: family with sequence similarity 114, member A2
  ENSP ID: ENSP00000428827
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPGPSEISTEVKYVAGETNAKENENSSPVAGAFGVFSTISTAVQSTG

SEQ ID NO: 29406 - protein, 79 aa, Homo sapiens
  Payload ID: 5740
  Gene Symbol: FAM114A2
  Gene Name: family with sequence similarity 114, member A2
  ENSP ID: ENSP00000428941
MSDKDDIETPLLTEAAPILEDGNCEPAKNSESVDQGAKPESKSEPVVSTRKRPETKPSSDLETSKVLPIQDNVSKDVPQ

SEQ ID NO: 29407 - protein, 435 aa, Homo sapiens
  Payload ID: 5740
  Gene Symbol: FAM114A2
  Gene Name: family with sequence similarity 114, member A2
  ENSP ID: ENSP00000429088
MSDKDDIETPLLTEAAPILEDGNCEPAKNSESVDQGISNVIEKAETSLGIPGPSEISTEVKYVAGETNAKENENSSPVAGAFGVFSTISTAVQSTGKSVISGGLDALEFIGKKTMDVIAEGDPGFKRTKGLMNRNATLSQVLREAKEKEEIRTSNEVTVETDKKTHYGLLFDEFQGLSHLEALEMLSQESEIKVKSILNSLSGEELETLKVELEQLKETFSLAEFCEEEEEEKKGDEDFTKDITELFSQLHVSSKPEKLARARNTAHEWIRKSLTKPLAENEEGEKQSEAENTEQVNKNSIEDIHAFAIRSLAELTACSIELFHKTAALVLHGRKQEVTAIERSQTLSQMTIVLCKELSSLSKEFTTCLTTAGVKEMADVLNPLITAVFLEASNSASYIQDAFQLLLPVLEISLIENKIESHRHELQGQKPLLEH

SEQ ID NO: 29408 - protein, 15 aa, Homo sapiens
  Payload ID: 5740
  Gene Symbol: FAM114A2
  Gene Name: family with sequence similarity 114, member A2
  ENSP ID: ENSP00000429403
MSDKDDIETPLLTEA

SEQ ID NO: 29409 - protein, 125 aa, Homo sapiens
  Payload ID: 5740
  Gene Symbol: FAM114A2
  Gene Name: family with sequence similarity 114, member A2
  ENSP ID: ENSP00000429753
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPGPSE

SEQ ID NO: 29410 - protein, 63 aa, Homo sapiens
  Payload ID: 5740
  Gene Symbol: FAM114A2
  Gene Name: family with sequence similarity 114, member A2
  ENSP ID: ENSP00000429919
MSDKDDIETPLLTEAAPILEDGNCEPAKNSESVDQGAKPESKSEPVVSTRKRPETKPSSDLET

SEQ ID NO: 29411 - protein, 210 aa, Homo sapiens
  Payload ID: 5740
  Gene Symbol: FAM114A2
  Gene Name: family with sequence similarity 114, member A2
  ENSP ID: ENSP00000430186
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPGPSEISTEVKYVAGETNAKENENSSPVAGAFGVFSTISTAVQSTGKSVISGGLDALEFIGKKTMDVIAEGDPGFKRTKGLMNRNATLSQ

SEQ ID NO: 29412 - protein, 505 aa, Homo sapiens; identical to SEQ ID NO: 29403
  Payload ID: 5740
  Gene Symbol: FAM114A2
  Gene Name: family with sequence similarity 114, member A2
  Uniprot ID: Q9NRY5
  ENSP ID: ENSP00000430384

SEQ ID NO: 29413 - protein, 505 aa, Homo sapiens; identical to SEQ ID NO: 29403
  Payload ID: 5740
  Gene Symbol: FAM114A2
  Gene Name: family with sequence similarity 114, member A2
  Uniprot ID: Q9NRY5
  ENSP ID: ENSP00000430489

SEQ ID NO: 29414 - protein, 249 aa, Homo sapiens [sequence omitted]

SEQ ID NO: 29415 - protein, 453 aa, Homo sapiens
  Payload ID: 5741
  Gene Symbol: FAM117A
  Gene Name: family with sequence similarity 117, member A
  Uniprot ID: Q9C073
  ENSP ID: ENSP00000240364
MAGAAAGGRGGGAWGPGRGGAGGLRRGCSPPAPAGSPRAGLQPLRATIPFQLQQPHQRRDGGGRAASVPCSVAPEKSVCRPQPLQVRRTFSLDTILSSYLLGQWPRDADGAFTCCTNDKATQTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 29416 - protein, 223 aa, Homo sapiens
  Payload ID: 5741
  Gene Symbol: FAM117A
  Gene Name: family with sequence similarity 117, member A
  ENSP ID: ENSP00000421412
MAGAAAGGRGGGAWGPGRGGAGGLRRGCSPPAPAGSPRAGLQPLRATIPFQLQQPHQRRDGGGRAASVPCSVAPEKSVCRPQPLQVRRTFSLDTILSSYLLGQWPRDADGAFTCCTNDKATQISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSC

SEQ ID NO: 29417 - protein, 230 aa, Homo sapiens
  Payload ID: 5741
  Gene Symbol: FAM117A
  Gene Name: family with sequence similarity 117, member A
  ENSP ID: ENSP00000427326
MWLFFPLCYHPPTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREP

SEQ ID NO: 29418 - protein, 181 aa, Homo sapiens
  Payload ID: 5741
  Gene Symbol: FAM117A
  Gene Name: family with sequence similarity 117, member A
  Uniprot ID: Q9C073
  ENSP ID: ENSP00000465808
MSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 29419 - protein, 55 aa, Homo sapiens
  Payload ID: 5741
  Gene Symbol: FAM117A
  Gene Name: family with sequence similarity 117, member A
  ENSP ID: ENSP00000467070
ASPPSFPSGSPVLRLSPCLHRSLEGLNQELEEVFVKEQGEEELLRSPGHRRSLPS

SEQ ID NO: 29420 - protein, 589 aa, Homo sapiens
  Payload ID: 5742
  Gene Symbol: FAM117B
  Gene Name: family with sequence similarity 117, member B
  Uniprot ID: Q6P1L5
  ENSP ID: ENSP00000376071
MSQRVRRNGSPTPAGSLGGGAVATAGGPGSRLQPMRATVPFQLKQQQQQQHGSPTRSGGGGGGNNNGGCCGGASGPAGGGGGGGPRTASRSTSPTRGGGNAAARTSPTVATQTGASATSTRGTSPTRSAAPGARGSPPRPPPPPPLLGTVSSPSSSPTHLWTGEVSAAPPPARVRHRRRSPEQSRSSPEKRSPSAPVCKAGDKTRQPSSSPSSIIRRTSSLDTLAAPYLAGHWPRDSHGQAAPCMRDKATQTESAWAEEYSEKKKGSHKRSASWGSTDQLKEIAKLRQQLQRSKHSSRHHRDKERQSPFHGNHAAINQCQAPVPKSALIPVIPITKSTGSRFRNSVEGLNQEIEIIIKETGEKEEQLIPQDIPDGHRAPPPLVQRSSSTRSIDTQTPGGADRGSNNSSRSQSVSPTSFLTISNEGSEESPCSADDLLVDPRDKENGNNSPLPKYATSPKPNNSYMFKREPPEGCERVKVFEECSPKQLHEIPAFYCPDKNKVNFIPKSGSAFCLVSILKPLLPTPDLTLKGSGHSLTVTTGMTTTLLQPIAVASLSTNTEQDRVSRGTSTVMPSASLLPPPEPIEEAEG

SEQ ID NO: 29421 - protein, 357 aa, Homo sapiens
  Payload ID: 5743
  Gene Symbol: FAM118A
  Gene Name: family with sequence similarity 118, member A
  Uniprot ID: Q9NWS6
  ENSP ID: ENSP00000216214
MDSVEKTTNRSEQKSRKFLKSLIRKQPQELLLVIGTGVSAAVAPGIPALCSWRSCIEAVIEAAEQLEVLHPGDVAEFRRKVTKDRDLLVVAHDLIRKMSPRTGDAKPSFFQDCLMEVFDDLEQHIRSPVVLQSILSLMDRGAMVLTTNYDNLLEAFGRRQNKPMESLDLKDKTKVLEWARGHMKYGVLHIHGLYTDPCGVVLDPSGYKDVTQDAEVMEVLQNLYRTKSFLFVGCGETLRDQIFQALFLYSVPNKVDLEHYMLVLKENEDHFFKHQADMLLHGIKVVSYGDCFDHFPGYVQDLATQICKQQSPDADRVDSTTLLGNACQDCAKRKLEENGIEVSKKRTQSDTDDAGGS

SEQ ID NO: 29422 - protein, 202 aa, Homo sapiens
  Payload ID: 5743
  Gene Symbol: FAM118A
  Gene Name: family with sequence similarity 118, member A
  ENSP ID: ENSP00000385231
MDSVEKTTNRSEQKSRKFLKSLIRKQPQELLLVIGTGVSAAVAPGIPALCSWRSCIEAVIEAAEQLEVLHPGDVAEFRRKVTKDRDLLVVAHDLIRKMSPRTGDAKPSFFQDCLMEVFDDLEQHIRSPVVLQSILSLMDRGAMVLTTNYDNLLEAFGRRQNKPMESLDLKDKTKVWAGAAGSLQVWGVLCPGSCSHFVAVNY

SEQ ID NO: 29423 - protein, 29 aa, Homo sapiens
  Payload ID: 5743
  Gene Symbol: FAM118A
  Gene Name: family with sequence similarity 118, member A
  ENSP ID: ENSP00000388511
MRNGGLGSILDNSQMDSVEKTTNRSEQKS

SEQ ID NO: 29424 - protein, 15 aa, Homo sapiens
  Payload ID: 5743
  Gene Symbol: FAM118A
  Gene Name: family with sequence similarity 118, member A
  ENSP ID: ENSP00000389298
MRNGGLGSILDNSQM

SEQ ID NO: 29425 - protein, 139 aa, Homo sapiens
  Payload ID: 5743
  Gene Symbol: FAM118A
  Gene Name: family with sequence similarity 118, member A
  ENSP ID: ENSP00000395194
MDSVEKTTNRSEQKSRKFLKSLIRKQPQELLLVIGTGVSAAVAPGIPALCSWRSCIEAVIEAAEQLEVLHPGDVAEFRRKVTKDRDLLVVAHDLIRKMSPRTGDAKPSFFQDCLMEVFDDLEQHIRSPVVLQSILSLMD

SEQ ID NO: 29426 - protein, 357 aa, Homo sapiens; identical to SEQ ID NO: 29421
  Payload ID: 5743
  Gene Symbol: FAM118A
  Gene Name: family with sequence similarity 118, member A
  Uniprot ID: Q9NWS6
  ENSP ID: ENSP00000395892

SEQ ID NO: 29427 - protein, 350 aa, Homo sapiens
  Payload ID: 5744
  Gene Symbol: FAM118B
  Gene Name: family with sequence similarity 118, member B
  ENSP ID: ENSP00000353321
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPRTSNVRSTFFKDCLYEVFDDLESKMEDSGKQLLQSVLHLMENGALVLTTNFDNLLELYAADQGKQLESLDLTDEKKVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLPEYFKRLTCEISTRGTSGMVREGQLNGSSAAHSEIRGCST

SEQ ID NO: 29428 - protein, 275 aa, Homo sapiens
  Payload ID: 5744
  Gene Symbol: FAM118B
  Gene Name: family with sequence similarity 118, member B
  ENSP ID: ENSP00000432712
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLPEYFKRLTCEISTRGTSAGMVREGQLNGSSAAHSEIRGCST

SEQ ID NO: 29429 - protein, 351 aa, Homo sapiens
  Payload ID: 5744
  Gene Symbol: FAM118B
  Gene Name: family with sequence similarity 118, member B
  Uniprot ID: Q9BPY3
  ENSP ID: ENSP00000433343
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPRTSNVRSTFFKDCLYEVFDDLESKMEDSGKQLLQSVLHLMENGALVLTTNFDNLLELYAADQGKQLESLDLTDEKKVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLPEYFKRLTCEISTRGTSAGMVREGQLNGSSAAHSEIRGCST

SEQ ID NO: 29430 - protein, 346 aa, Homo sapiens
  Payload ID: 5744
  Gene Symbol: FAM118B
  Gene Name: family with sequence similarity 118, member B
  ENSP ID: ENSP00000434952
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPRTSNVRSTFFKDCLYEVFDDLESKMEDSGKQLLQSVLHLMENGALVLTTNFDNLLELYAADQGKQLESLDLTDEKKVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLPEYFKRLTCEISTRGTSGMVREGQLNGSSAAHSEIR

SEQ ID NO: 29431 - protein, 235 aa, Homo sapiens
  Payload ID: 5744
  Gene Symbol: FAM118B
  Gene Name: family with sequence similarity 118, member B
  ENSP ID: ENSP00000435754
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLP

SEQ ID NO: 29432 - protein, 153 aa, Homo sapiens
  Payload ID: 5744
  Gene Symbol: FAM118B
  Gene Name: family with sequence similarity 118, member B
  ENSP ID: ENSP00000437285
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPRTSNVRSTFFKDCLYEVFDDLESKMEDSGKQLLQSVLHLM

SEQ ID NO: 29433 - protein, 275 aa, Homo sapiens; identical to SEQ ID NO: 29428
  Payload ID: 5744
  Gene Symbol: FAM118B
  Gene Name: family with sequence similarity 118, member B
  ENSP ID: ENSP00000487554

SEQ ID NO: 29434 - protein, 1118 aa, Homo sapiens
  Payload ID: 5745
  Gene Symbol: FAM120A
  Gene Name: family with sequence similarity 120A
  Uniprot ID: Q9NZB2
  ENSP ID: ENSP00000277165
MGVQGFQDYIEKHCPSAVVPVELQKLARGSLVGGGRQRPPQTPLRLLVDADNCLHRLYGGFYTDWVSGGQWNHMLGYLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVCGFGGPYGETVATGPYRAFRVAAASGHCGAFSGSDSSRTSKSQGGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 29435 - protein, 628 aa, Homo sapiens
  Payload ID: 5745
  Gene Symbol: FAM120A
  Gene Name: family with sequence similarity 120A
  Uniprot ID: Q9NZB2
  ENSP ID: ENSP00000364538
MGVQGFQDYIEKHCPSAVVPVELQKLARGSLVGGGRQRPPQTPLRLLVDADNCLHRLYGGFYTDWVSGGQWNHMLGYLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKVLSKGPWSGFCYLMSGHSYGCFVLLSFFEPFFCLTNLLETKFTFPFLNIE

SEQ ID NO: 29436 - protein, 495 aa, Homo sapiens
  Payload ID: 5745
  Gene Symbol: FAM120A
  Gene Name: family with sequence similarity 120A
  ENSP ID: ENSP00000396534
VKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPECMYCNNPLFVFLGTS

SEQ ID NO: 29437 - protein, 494 aa, Homo sapiens
  Payload ID: 5745
  Gene Symbol: FAM120A
  Gene Name: family with sequence similarity 120A
  ENSP ID: ENSP00000412440
GEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 29438 - protein, 256 aa, Homo sapiens
  Payload ID: 5746
  Gene Symbol: FAM120AOS
  Gene Name: family with sequence similarity 120A opposite strand
  Uniprot ID: Q5T036
  ENSP ID: ENSP00000364561
MGKTKDIGDDDTVASEFWSGALSQPSSVPTRPRTPNRDSWRRAWAARGLHPRPSILQPGPARLSRARAGGTRCPQRRHGRATFCALGRGIGVRRGPGPRPARIPGLTLTWKRMSARRMQWAMQTGGRNQTFGGGVPLFWTWLTICCAVWRSLPCRLTHSCSRAFSSAPLKKTKSSMLPPKQALASAARNLCRGAGCNRQAVAGQLLPSTWSLHAHGLAKEAPILPVKKISRSCSVNNKVSKKTTKPPTLRSFLSPI

SEQ ID NO: 29439 - protein, 74 aa, Homo sapiens
  Payload ID: 5746
  Gene Symbol: FAM120AOS
  Gene Name: family with sequence similarity 120A opposite strand
  ENSP ID: ENSP00000414298
MQFRGRNLCRGAGCNRQAVAGQLLPSTWSLHAHGLAKEAPILPVKKISRSCSVNNKVSKKTTKPPTLRSFLSPI

SEQ ID NO: 29440 - protein, 66 aa, Homo sapiens
  Payload ID: 5746
  Gene Symbol: FAM120AOS
  Gene Name: family with sequence similarity 120A opposite strand
  ENSP ID: ENSP00000416978
MRLILNLCRGAGCNRQAVAGQLLPSTWSLHAHGLAKEAPILPVKKISRSCSVNNKVSKKTTKPPTL

SEQ ID NO: 29441 - protein, 58 aa, Homo sapiens
  Payload ID: 5746
  Gene Symbol: FAM120AOS
  Gene Name: family with sequence similarity 120A opposite strand
  ENSP ID: ENSP00000429212
MQFRGRNLCRGAGCNRQAVAGQLLPSTWSLHAHGLAKEAPILPVKKMESCSVAQAGVQ

SEQ ID NO: 29442 - protein, 910 aa, Homo sapiens
  Payload ID: 5747
  Gene Symbol: FAM120B
  Gene Name: family with sequence similarity 120B
  Uniprot ID: Q96EK7
  ENSP ID: ENSP00000417970
MGVRGLQGFVGSTCPHICTVVNFKELAEHHRSKYPGCTPTIVVDAMCCLRYWYTPESWICGGQWREYFSALRDFVKTFTAAGIKLIFFFDGMVEQDKRDEWVKRRLKNNREISRIFHYIKSHKEQPGRNMFFIPSGLAVFTRFALKTLGQETLCSLQEADYEVASYGLQHNCLGILGEDTDYLIYDTCPYFSISELCLESLDTVMLCREKLCESLGLCVADLPLLACLLGNDIIPEGMFESFRYKCLSSYTSVKENFDKKGNIILAVSDHISKVLYLYQGEKKLEEILPLGPNKALFYKGMASYLLPGQKSPWFFQKPKGVITLDKQVISTSSDAESREEVPMCSDAESRQEVPMCTGPESRREVPVYTDSEPRQEVPMCSDPEPRQEVPTCTGPESRREVPMCSDPEPRQEVPMCTGPEARQEVPMYTDSEPRQEVPMYTDSEPRQEVPMYTGSEPRQEVPMYTGPESRQEVPMYTGPESRQEVLIRTDPESRQEIMCTGHESKQEVPICTDPISKQEDSMCTHAEINQKLPVATDFEFKLEALMCTNPEIKQEDPTNVGPEVKQQVTMVSDTEILKVARTHHVQAESYLVYNIMSSGEIECSNTLEDELDQALPSQAFIYRPIRQRVYSLLLEDCQDVTSTCLAVKEWFVYPGNPLRHPDLVRPLQMTIPGGTPSLKILWLNQEPEIQVRRLDTLLACFNLSSSREELQAVESPFQALCCLLIYLFVQVDTLCLEDLHAFIAQALCLQGKSTSQLVNLQPDYINPRAVQLGSLLVRGLTTLVLVNSACGFPWKTSDFMPWNVFDGKLFHQKYLQSEKGYAVEVLLEQNRSRLTKFHNLKAVVCKACMKENRRITGRAHWGSHHAGRWGRQGSSYHRTGSGYSRSSQGQPWRDQGPGSRQYEHDQWRRY

SEQ ID NO: 29443 - protein, 933 aa, Homo sapiens
  Payload ID: 5747
  Gene Symbol: FAM120B
  Gene Name: family with sequence similarity 120B
  ENSP ID: ENSP00000440125
MFGPRGSTSAGAGRKEILSRSSVMGVRGLQGFVGSTCPHICTVVNFKELAEHHRSKYPGCTPTIVVDAMCCLRYWYTPESWICGGQWREYFSALRDFVKTFTAAGIKLIFFFDGMVEQDKRDEWVKRRLKNNREISRIFHYIKSHKEQPGRNMFFIPSGLAVFTRFALKTLGQETLCSLQEADYEVASYGLQHNCLGILGEDTDYLIYDTCPYFSISELCLESLDTVMLCREKLCESLGLCVADLPLLACLLGNDIIPEGMFESFRYKCLSSYTSVKENFDKKGNIILAVSDHISKVLYLYQGEKKLEEILPLGPNKALFYKGMASYLLPGQKSPWFFQKPKGVITLDKQVISTSSDAESREEVPMCSDAESRQEVPMCTGPESRREVPVYTDSEPRQEVPMCSDPEPRQEVPTCTGPESRREVPMCSDPEPRQEVPMCTGPEARQEVPMYTDSEPRQEVPMYTDSEPRQEVPMYTGSEPRQEVPMYTGPESRQEVPMYTGPESRQEVLIRTDPESRQEIMCTGHESKQEVPICTDPISKQEDSMCTHAEINQKLPVATDFEFKLEALMCTNPEIKQEDPTNVGPEVKQQVTMVSDTEILKVARTHHVQAESYLVYNIMSSGEIECSNTLEDELDQALPSQAFIYRPIRQRVYSLLLEDCQDVTSTCLAVKEWFVYPGNPLRHPDLVRPLQMTIPGGTPSLKILWLNQEPEIQVRRLDTLLACFNLSSSREELQAVESPFQALCCLLIYLFVQVDTLCLEDLHAFIAQALCLQGKSTSQLVNLQPDYINPRAVQLGSLLVRGLTTLVLVNSACGFPWKTSDFMPWNVFDGKLFHQKYLQSEKGYAVEVLLEQNRSRLTKFHNLKAVVCKACMKENRRITGRAHWGSHHAGRWGRQGSSYHRTGSGYSRSSQGQPWRDQGPGSRQYEHDQWRRY

SEQ ID NO: 29444 - protein, 922 aa, Homo sapiens
  Payload ID: 5747
  Gene Symbol: FAM120B
  Gene Name: family with sequence similarity 120B
  ENSP ID: ENSP00000477556
MDRQMILSRSSVMGVRGLQGFVGSTCPHICTVVNFKELAEHHRSKYPGCTPTIVVDAMCCLRYWYTPESWICGGQWREYFSALRDFVKTFTAAGIKLIFFFDGMVEQDKRDEWVKRRLKNNREISRIFHYIKSHKEQPGRNMFFIPSGLAVFTRFALKTLGQETLCSLQEADYEVASYGLQHNCLGILGEDTDYLIYDTCPYFSISELCLESLDTVMLCREKLCESLGLCVADLPLLACLLGNDIIPEGMFESFRYKCLSSYTSVKENFDKKGNIILAVSDHISKVLYLYQGEKKLEEILPLGPNKALFYKGMASYLLPGQKSPWFFQKPKGVITLDKQVISTSSDAESREEVPMCSDAESRQEVPMCTGPESRREVPVYTDSEPRQEVPMCSDPEPRQEVPTCTGPESRREVPMCSDPEPRQEVPMCTGPEARQEVPMYTDSEPRQEVPMYTDSEPRQEVPMYTGSEPRQEVPMYTGPESRQEVPMYTGPESRQEVLIRTDPESRQEIMCTGHESKQEVPICTDPISKQEDSMCTHAEINQKLPVATDFEFKLEALMCTNPEIKQEDPTNVGPEVKQQVTMVSDTEILKVARTHHVQAESYLVYNIMSSGEIECSNTLEDELDQALPSQAFIYRPIRQRVYSLLLEDCQDVTSTCLAVKEWFVYPGNPLRHPDLVRPLQMTIPGGTPSLKILWLNQEPEIQVRRLDTLLACFNLSSSREELQAVESPFQALCCLLIYLFVQVDTLCLEDLHAFIAQALCLQGKSTSQLVNLQPDYINPRAVQLGSLLVRGLTTLVLVNSACGFPWKTSDFMPWNVFDGKLFHQKYLQSEKGYAVEVLLEQNRSRLTKFHNLKAVVCKACMKENRRITGRAHWGSHHAGRWGRQGSSYHRTGSGYSRSSQGQPWRDQGPGSRQYEHDQWRRY

SEQ ID NO: 29445 - protein, 933 aa, Homo sapiens; identical to SEQ ID NO: 29443
  Payload ID: 5747
  Gene Symbol: FAM120B
  Gene Name: family with sequence similarity 120B
  ENSP ID: ENSP00000479118

SEQ ID NO: 29446 - protein, 910 aa, Homo sapiens; identical to SEQ ID NO: 29442
  Payload ID: 5747
  Gene Symbol: FAM120B
  Gene Name: family with sequence similarity 120B
  Uniprot ID: Q96EK7
  ENSP ID: ENSP00000481344

SEQ ID NO: 29447 - protein, 242 aa, Homo sapiens
  Payload ID: 5747
  Gene Symbol: FAM120B
  Gene Name: family with sequence similarity 120B
  Uniprot ID: Q96EK7
  ENSP ID: ENSP00000482544
MTIPGGTPSLKILWLNQEPEIQVRRLDTLLACFNLSSSREELQAVESPFQALCCLLIYLFVQVDTLCLEDLHAFIAQALCLQGKSTSQLVNLQPDYINPRAVQLGSLLVRGLTTLVLVNSACGFPWKTSDFMPWNVFDGKLFHQKYLQSEKGYAVEVLLEQNRSRLTKFHNLKAVVCKACMKENRRITGRAHWGSHHAGRWGRQGSSYHRTGSGYSRSSQGQPWRDQGPGSRQYEHDQWRRY

SEQ ID NO: 29448 - protein, 922 aa, Homo sapiens; identical to SEQ ID NO: 29444
  Payload ID: 5747
  Gene Symbol: FAM120B
  Gene Name: family with sequence similarity 120B
  ENSP ID: ENSP00000485745

SEQ ID NO: 29449 - protein, 242 aa, Homo sapiens; identical to SEQ ID NO: 29447
  Payload ID: 5747
  Gene Symbol: FAM120B
  Gene Name: family with sequence similarity 120B
  Uniprot ID: Q96EK7
  ENSP ID: ENSP00000485793

SEQ ID NO: 29450 - protein, 895 aa, Homo sapiens
  Payload ID: 5748
  Gene Symbol: FAM120C
  Gene Name: family with sequence similarity 120C
  ENSP ID: ENSP00000329896
MGVQGFQEFLEKRCPGAVVPVDLLKLARTVSRQQQQQHLHRQLPPTAALAPGAPRAARGSVPLQPPLPPAALGAYSGGAGPTRHHHPAHHFHHHGQAQPGLHPPLPPPPPPQLPGARVLVDAGSALPRLYGGYQTDWVCGGQWNAMLGYLSALCQACAYPGGDGLELVVMFPGGLGKDRLAEWGRRCQAERQTAQLIVGHVGNKGTPPPRAWFLPPACLSHCVRLALIRFRVKVFQSLEDHHLEVVAFFRENGFHGLLAHDSEYALYNIPSYYSSHALKLSWNGKNLTTNQFLMQEVAKQLGLKRMNFPIFAALLGNHILPDEDLAAFHWSLLGPEHPLASLKVRAHQLVLPPCDVVIKAVSEYVSSIKDPSNLDVVGKDVFKQSQSRTEDKIERFKKAVEYYSVTTKLSSLPVGPSFLGFRNNRLGNPPLPRNQVGTISAGKPMFSHQVPQKVKYPPPFPVGPNSSLLFSSHALGESHAFSEDPMLQNSPFANWAVSYDSSASQFPNYLPSKASPPLGPDSSHSSSSDGDEPNGASSDHITEAFHHQPEWGNPNRDRGSWAQPVDTGVSEASLGDGEPHIPSLLSMSTRNHMDITIPPLPPVAPEVLRVAEHRHRRGLMYPYIYHVLTKGEIKIPVCIEDECNMELPPAALLFRSARQYVYGVLFSLAETQRKMERLAMRRRLPVEVPSVILKEWSAYKGKSPQTPELVSALTFREWTCPNLKKLWLGKAVEDKNRRMRAFLACMKSDTPSMLNPANVPTHLLLMCCVLRYMVQWPGGRILHRHELDTFLAQAVSTQLYEPDRLQELKVSIQSHPKEENWRLLGWLWASGLAADPPGAEDPSACKWFLSVGQERGMEKNRLVEDPRDTKKEISKALQMEFLNPWSFIKVGLAPR

SEQ ID NO: 29451 - protein, 1096 aa, Homo sapiens
  Payload ID: 5748
  Gene Symbol: FAM120C
  Gene Name: family with sequence similarity 120C
  Uniprot ID: Q9NX05
  ENSP ID: ENSP00000364324
MGVQGFQEFLEKRCPGAVVPVDLLKLARTVSRQQQQQHLHRQLPPTAALAPGAPRAARGSVPLQPPLPPAALGAYSGGAGPTRHHHPAHHFHHHGQAQPGLHPPLPPPPPPQLPGARVLVDAGSALPRLYGGYQTDWVCGGQWNAMLGYLSALCQACAYPGGDGLELVVMFPGGLGKDRLAEWGRRCQAERQTAQLIVGHVGNKGTPPPRAWFLPPACLSHCVRLALIRFRVKVFQSLEDHHLEVVAFFRENGFHGLLAHDSEYALYNIPSYYSSHALKLSWNGKNLTTNQFLMQEVAKQLGLKRMNFPIFAALLGNHILPDEDLAAFHWSLLGPEHPLASLKVRAHQLVLPPCDVVIKAVSEYVSSIKDPSNLDVVGKDVFKQSQSRTEDKIERFKKAVEYYSVTTKLSSLPVGPSFLGFRNNRLGNPPLPRNQVGTISAGKPMFSHQVPQKVKYPPPFPVGPNSSLLFSSHALGESHAFSEDPMLQNSPFANWAVSYDSSASQFPNYLPSKASPPLGPDSSHSSSSDGDEPNGASSDHITEAFHHQPEWGNPNRDRGSWAQPVDTGVSEASLGDGEPHIPSLLSMSTRNHMDITIPPLPPVAPEVLRVAEHRHRRGLMYPYIYHVLTKGEIKIPVCIEDECNMELPPAALLFRSARQYVYGVLFSLAETQRKMERLAMRRRLPVEVPSVILKEWSAYKGKSPQTPELVSALTFREWTCPNLKKLWLGKAVEDKNRRMRAFLACMKSDTPSMLNPANVPTHLLLMCCVLRYMVQWPGGRILHRHELDTFLAQAVSTQLYEPDRLQELKIEKLDARGIQLAALFMSGVDTALFANDACGQPVPWEHCCPWIYFDGKLFQSKLIKAGRERVSLVELCDGQADLATKVEKMRQSILEGVNMNHPPPSALLPSPTFVPPMVPSLYPVSLYSRAMGSMPLPPQGRSRGFAGLHPIPPQGGKLEIAGMVVGQWAGSRSSRGRGSFGMQVVSVGGPGKGHGKEQTGRGSKGHKKGNKQGSSDGVSKSLELHQGRSRSQVNGNSGALIKEEKSDHRLPAPSQCALSRDSNECNNGNRYLPMNNREKNHLQEQKLETVAQRKED

SEQ ID NO: 29452 - protein, 238 aa, Homo sapiens
  Payload ID: 5748
  Gene Symbol: FAM120C
  Gene Name: family with sequence similarity 120C
  Uniprot ID: Q9NX05
  ENSP ID: ENSP00000420718
MGVQGFQEFLEKRCPGAVVPVDLLKLARTVSRQQQQQHLHRQLPPTAALAPGAPRAARGSVPLQPPLPPAALGAYSGGAGPTRHHHPAHHFHHHGQAQPGLHPPLPPPPPPQLPGARVLVDAGSALPRLYGGYQTDWVCGGQWNAMLGYLSALCQACAYPGGDGLELVVMFPGGLGKDRLAEWGRRCQAERQTAQLIVGHVGNKGTPPPRAWFLPPACLSHCVRLALIRFRVKQAAML

SEQ ID NO: 29453 - protein, 287 aa, Homo sapiens
  Payload ID: 5749
  Gene Symbol: FAM122A
  Gene Name: family with sequence similarity 122A
  Uniprot ID: Q96E09
  ENSP ID: ENSP00000377807
MAQEKMELDLELPPGTGGSPAEGGGSGGGGGLRRSNSAPLIHGLSDTSPVFQAEAPSARRNSTTFPSRHGLLLPASPVRMHSSRLHQIKQEEGMDLINRETVHEREVQTAMQISHSWEESFSLSDNDVEKSASPKRIDFIPVSPAPSPTRGIGKQCFSPSLQSFVSSNGLPPSPIPSPTTRFTTRRSQSPINCIRPSVLGPLKRKCEMETEYQPKRFFQGITNMLSSDVAQLSDPGVCVSSDTLDGNSSSAGSSCNSPAKVSTTTDSPVSPAQAASPFIPLDELSSK

SEQ ID NO: 29454 - protein, 241 aa, Homo sapiens
  Payload ID: 5750
  Gene Symbol: FAM122B
  Gene Name: family with sequence similarity 122B
  Uniprot ID: Q7Z309
  ENSP ID: ENSP00000298090
MAQEKMELDLEPDTSYGGTLRRSSSAPLIHGLSDLSQVFQPYTLRTRRNSTTIMSRHSLLLSSSPNRIPSSRLHQIKREEGLDMVNRETAHEREMQTAMQISQSWDESLSLSDSDFDKPEKLYSPKRIDFTPVSPAPSPTRGFGKMFVSSSGLPPSPVPSPRRFSRRSQSPVKCIRPSVLGPLKRKGEMETESQPKRLFQGTTNMLSPDAAQLSDLSSWWCYQGEEIPALTRCVEHLQMNE

SEQ ID NO: 29455 - protein, 267 aa, Homo sapiens
  Payload ID: 5750
  Gene Symbol: FAM122B
  Gene Name: family with sequence similarity 122B
  ENSP ID: ENSP00000339207
MAQEKMELDLEPDTSYGGTLRRSSSAPLIHGLSDLSQVFQPYTLRTRRNSTTIMSRHSLLLSSSPNRIPSSRLHQIKREEGLDMVNRETAHEREMQTAMQISQSWDESLSLSDSDFDKPEKLYSPKRIDFTPVSPAPSPTRGFGKMFVSSSGLPPSPVPSPRRFSSRRSQSPVKCIRPSVLGPLKRKGEMETESQPKRLFQGTTNMLSPDAAQLSDLSSCSDILDGSSSSSGLSSDPLAKGSATAESPVACSNSCSSFILMDDLSPK

SEQ ID NO: 29456 - protein, 247 aa, Homo sapiens
  Payload ID: 5750
  Gene Symbol: FAM122B
  Gene Name: family with sequence similarity 122B
  Uniprot ID: Q7Z309
  ENSP ID: ENSP00000359826
MAQEKMELDLEPDTSYGGTLRRSSSAPLIHGLSDLSQVFQPYTLRTRRNSTTIMSRHSLEEGLDMVNRETAHEREMQTAMQISQSWDESLSLSDSDFDKPEKLYSPKRIDFTPVSPAPSPTRGFGKMFVSSSGLPPSPVPSPRRFSRRSQSPVKCIRPSVLGPLKRKGEMETESQPKRLFQGTTNMLSPDAAQLSDLSSCSDILDGSSSSSGLSSDPLAKGSATAESPVACSNSCSSFILMDDLSPK

SEQ ID NO: 29457 - protein, 248 aa, Homo sapiens
  Payload ID: 5750
  Gene Symbol: FAM122B
  Gene Name: family with sequence similarity 122B
  Uniprot ID: Q7Z309
  ENSP ID: ENSP00000419592
MAQEKMELDLEPDTSYGGTLRRSSSAPLIHGLSDLSQVFQPYTLRTRRNSTTIMSRHSLEEGLDMVNRETAHEREMQTAMQISQSWDESLSLSDSDFDKPEKLYSPKRIDFTPVSPAPSPTRGFGKMFVSSSGLPPSPVPSPRRFSSRRSQSPVKCIRPSVLGPLKRKGEMETESQPKRLFQGTTNMLSPDAAQLSDLSSCSDILDGSSSSSGLSSDPLAKGSATAESPVACSNSCSSFILMDDLSPK

SEQ ID NO: 29458 - protein, 267 aa, Homo sapiens; identical to SEQ ID NO: 29455
  Payload ID: 5750
  Gene Symbol: FAM122B
  Gene Name: family with sequence similarity 122B
  ENSP ID: ENSP00000479150

SEQ ID NO: 29459 - protein, 266 aa, Homo sapiens
  Payload ID: 5750
  Gene Symbol: FAM122B
  Gene Name: family with sequence similarity 122B
  Uniprot ID: Q7Z309
  ENSP ID: ENSP00000487221
MAQEKMELDLEPDTSYGGTLRRSSSAPLIHGLSDLSQVFQPYTLRTRRNSTTIMSRHSLLLSSSPNRIPSSRLHQIKREEGLDMVNRETAHEREMQTAMQISQSWDESLSLSDSDFDKPEKLYSPKRIDFTPVSPAPSPTRGFGKMFVSSSGLPPSPVPSPRRFSRRSQSPVKCIRPSVLGPLKRKGEMETESQPKRLFQGTTNMLSPDAAQLSDLSSCSDILDGSSSSSGLSSDPLAKGSATAESPVACSNSCSSFILMDDLSPK

SEQ ID NO: 29460 - protein, 195 aa, Homo sapiens
  Payload ID: 5751
  Gene Symbol: FAM122C
  Gene Name: family with sequence similarity 122C
  Uniprot ID: Q6P4D5
  ENSP ID: ENSP00000359820
MAQEKMKLGFKSLPSSTTADGNILRRVNSAPLINGLGFNSQVLQADMLRIRTNRTTFRNRRSLLLPPPPFHGSISRLHQIKQEEAMDLINRETMSEWKLQSEIQISHSWEEGLKLVKWHFNINQKRFSKAQPTCFLLILPNCQKIMCIYFQLLLMETTAMLDLLVIRQLKSALSQTLLCHLLILVLICSSRQTFN

SEQ ID NO: 29461 - protein, 152 aa, Homo sapiens
  Payload ID: 5751
  Gene Symbol: FAM122C
  Gene Name: family with sequence similarity 122C
  Uniprot ID: Q6P4D5
  ENSP ID: ENSP00000359821
MAQEKMKLGFKSLPSSTTADGNILRRVNSAPLINGLGFNSQVLQADMLRIRTNRTTFRNRRSLLLPPPPFHGSISRLHQIKQEEAMDLINRETMSEWKLQSEIQISHSWEEGLKLNDNGLQKSSSLKCIDLTPVSSMASSIKKTGKSTSSYF

SEQ ID NO: 29462 - protein, 115 aa, Homo sapiens
  Payload ID: 5751
  Gene Symbol: FAM122C
  Gene Name: family with sequence similarity 122C
  Uniprot ID: Q6P4D5
  ENSP ID: ENSP00000402477
MAYFPGTGRTDQETQLDLSLCGREPESLENLFLDPDMAQEKMKLGFKSLPSSTTADGNILRRVNSAPLINGLGFNSQVLQADMLRIRTNRTTFRNRRSLEITSPTSVEQKPKDLF

SEQ ID NO: 29463 - protein, 79 aa, Homo sapiens
  Payload ID: 5751
  Gene Symbol: FAM122C
  Gene Name: family with sequence similarity 122C
  ENSP ID: ENSP00000485120
MAQEKMKLGFKSLPSSTTADGNILRRVNSAPLINGLGFNSQVLQADMLRIRTNRTTFRNRRSLEITSPTSVEQKPKDLF

SEQ ID NO: 29464 - protein, 582 aa, Homo sapiens
  Payload ID: 5752
  Gene Symbol: FAM124A
  Gene Name: family with sequence similarity 124A
  Uniprot ID: Q86V42
  ENSP ID: ENSP00000280057
MDPKAGGGGEEDDCVDSGAETGGSDYSHLSSTSNGFSTWRMPCCLFLYCTHGDKEKGRWSLQVEHTWPSGELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDGNKILLQAQRVHKKFPKPGRVHHASEKKRHSTPLPSTAVPSHTPGSSQQSPLNSPHPGPIRTGLPPGHQQEFAGRANSTPNPPWSFQRSKSLFCLPTGGPSLASSAEPQWFSNTGAPGHRASEWRHGHLLSIDDLEGAQETDVDTGLRLSSSDLSVVSAYSAPSRFCSTVETPLPSERCSSHWAAHKDSREGPLPTVSRVTTEASWASLPFFTKRSSSSSATARAAPPAPSTSTLTDSSPQLPCDTPKVKQTDGDMPPPPGSAGPGDNDMEEFYI

SEQ ID NO: 29465 - protein, 546 aa, Homo sapiens
  Payload ID: 5752
  Gene Symbol: FAM124A
  Gene Name: family with sequence similarity 124A
  Uniprot ID: Q86V42
  ENSP ID: ENSP00000324625
MDPKAGGGGEEDDCVDSGAETGGSDYSHLSSTSSELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDGNKILLQAQRVHKKFPKPGRVHHASEKKRHSTPLPSTAVPSHTPGSSQQSPLNSPHPGPIRTGLPPGHQQEFAGRANSTPNPPWSFQRSKSLFCLPTGGPSLASSAEPQWFSNTGAPGHRASEWRHGHLLSIDDLEGAQETDVDTGLRLSSSDLSVVSAYSAPSRFCSTVETPLPSERCSSHWAAHKDSREGPLPTVSRVTTEASWASLPFFTKRSSSSSATARAAPPAPSTSTLTDSSPQLPCDTPKVKQTDGDMPPPPGSAGPGDNDMEEFYI

SEQ ID NO: 29466 - protein, 301 aa, Homo sapiens
  Payload ID: 5752
  Gene Symbol: FAM124A
  Gene Name: family with sequence similarity 124A
  Uniprot ID: Q86V42
  ENSP ID: ENSP00000481212
MDPKAGGGGEEDDCVDSGAETGGSDYSHLSSTSSELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDGNKILLQVLGGRLSVCLGDLRNQLALPQTL

SEQ ID NO: 29467 - protein, 286 aa, Homo sapiens
  Payload ID: 5752
  Gene Symbol: FAM124A
  Gene Name: family with sequence similarity 124A
  ENSP ID: ENSP00000483855
MDPKAGGGGEEDDCVDSGAETGGSDYSHLSSTSSELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDGNKILLQVLGGRLSV

SEQ ID NO: 29468 - protein, 272 aa, Homo sapiens
  Payload ID: 5753
  Gene Symbol: FAM124B
  Gene Name: family with sequence similarity 124B
  Uniprot ID: Q9H5Z6
  ENSP ID: ENSP00000243806
MDETQGPLAMTVHLLANSGHGSLLQRTLDQLLDCICPEVRLFQVSERASPVKYCEKSHSKRSRFPGMSVLLFLHESPGEDRLFRVLDSLQHSPWQCYPTQDTRGRLCPYFFANQEFYSLDSQLPIWGVRQVHCGSEILRVTLYCSFDNYEDAIRLYEMILQREATLQKSNFCFFVLYASKSFALQLSLKQLPPGMSVDPKESSVLQFKVQEIGQLVPLLPNPCMPISSTRWQTQDYDGNKILLQRWESSSVAQTRVRWCHHSSLRSSPSGFK

SEQ ID NO: 29469 - protein, 272 aa, Homo sapiens; identical to SEQ ID NO: 29468
  Payload ID: 5753
  Gene Symbol: FAM124B
  Gene Name: family with sequence similarity 124B
  Uniprot ID: Q9H5Z6
  ENSP ID: ENSP00000374524

SEQ ID NO: 29470 - protein, 455 aa, Homo sapiens
  Payload ID: 5753
  Gene Symbol: FAM124B
  Gene Name: family with sequence similarity 124B
  Uniprot ID: Q9H5Z6
  ENSP ID: ENSP00000386895
MDETQGPLAMTVHLLANSGHGSLLQRTLDQLLDCICPEVRLFQVSERASPVKYCEKSHSKRSRFPGMSVLLFLHESPGEDRLFRVLDSLQHSPWQCYPTQDTRGRLCPYFFANQEFYSLDSQLPIWGVRQVHCGSEILRVTLYCSFDNYEDAIRLYEMILQREATLQKSNFCFFVLYASKSFALQLSLKQLPPGMSVDPKESSVLQFKVQEIGQLVPLLPNPCMPISSTRWQTQDYDGNKILLQVQLNPELGVKNGILGAGMLPLGSRLTSVSAKRTSEPRSQRNQGKRSQGHSLELPEPSGSPTSDRCAGTSWKSPGRSFQVSSPAMGAHLHLSSHHLESGARMKVLNRENSFQKLEAETNVDTGLTIINSEPRQTYFGGFPRDLQTSQPPFCLPASSLGVATSKNNSVLKERVSPLPLAGQRDLGTRKTISECLLHLQVQGEEKEEDEEEFFI

SEQ ID NO: 29471 - protein, 419 aa, Homo sapiens
  Payload ID: 5754
  Gene Symbol: FAM126A
  Gene Name: family with sequence similarity 126, member A
  ENSP ID: ENSP00000386246
MFTSEKGVVEEWLSEFKTLPETSLPNYATNLKDKSSLVSSLYKVIQEPQSELLEPVCHQLFEFYRSGEEQLLQFTLQFLPELIWCYLAVSASRNVHSSGCIEALLLGVYNLEIVDKQGHTKVLSFTIPSLSKPSVYHEPSSIGSMALTESALSQHGLSKVVYSGPHPQREMLTAQNRFEVLTFLLLCYNAALTYMPSVSLQSLCQICSRICVCGYPRQHVRKYKGISSRIPVSSGFMVQMLTGIYFAFYNGEWDLAQKALDDIIYRAQLELYPEPLLVANAIKASLPHGPMKSNKEGTRCIQVEITPTSSRISRNAVTSMSIRGHRWKRHEQPDNNNDATELGILVIPEISVTNVAGERTGNGEKGRTLGEIDAQHIQGVQETATDPRTESKGLPEIRRQKSVRKMMEDGINSPGRVQF

SEQ ID NO: 29472 - protein, 114 aa, Homo sapiens
  Payload ID: 5754
  Gene Symbol: FAM126A
  Gene Name: family with sequence similarity 126, member A
  ENSP ID: ENSP00000386624
MFTSEKGVVEEWLSEFKTLPETSLPNYATNLKDKSSLVSSLYKVIQEPQSELLEPVCHQLFEFYRSGEEQLLQFTLQFLPELIWCYLAVSASRNVHSSGCIEALLLGVYNLVCI

SEQ ID NO: 29473 - protein, 471 aa, Homo sapiens
  Payload ID: 5754
  Gene Symbol: FAM126A
  Gene Name: family with sequence similarity 126, member A
  ENSP ID: ENSP00000397168
  MOD_RES (1)..(1): Any amino acid
XRGWRQWWLSRLGCQSVRGGGRWLTGTRSARKKGSRWCCYSGGSRAASVAVAESLTSRGPAGGAPAAALTLPETSLPNYATNLKDKSSLVSSLYKVIQEPQSELLEPVCHQLFEFYRSGEEQLLQFTLQFLPELIWCYLAVSASRNVHSSGCIEALLLGVYNLEIVDKQGHTKVLSFTIPSLSKPSVYHEPSSIGSMALTESALSQHGLSKVVYSGPHPQREMLTAQNRFEVLTFLLLCYNAALTYMPSVSLQSLCQICSRICVCGYPRQHVRKYKGISSRIPVSSGFMVQMLTGIYFAFYNGEWDLAQKALDDIIYRAQLELYPEPLLVANAIKASLPHGPMKSNKEGTRCIQVEITPTSSRISRNAVTSMSIRGHRWKRHEQPDNNNDATELGILVIPEISVTNVAGERTGNGEKGRTLGEIDAQHIQGVQETATDPRTESKGLPEIRRQKSVRKMMEDGINSPGRVQF

SEQ ID NO: 29474 - protein, 521 aa, Homo sapiens
  Payload ID: 5754
  Gene Symbol: FAM126A
  Gene Name: family with sequence similarity 126, member A
  Uniprot ID: Q9BYI3
  ENSP ID: ENSP00000403396
MFTSEKGVVEEWLSEFKTLPETSLPNYATNLKDKSSLVSSLYKVIQEPQSELLEPVCHQLFEFYRSGEEQLLQFTLQFLPELIWCYLAVSASRNVHSSGCIEALLLGVYNLEIVDKQGHTKVLSFTIPSLSKPSVYHEPSSIGSMALTESALSQHGLSKVVYSGPHPQREMLTAQNRFEVLTFLLLCYNAALTYMPSVSLQSLCQICSRICVCGYPRQHVRKYKGISSRIPVSSGFMVQMLTGIYFAFYNGEWDLAQKALDDIIYRAQLELYPEPLLVANAIKASLPHGPMKSNKEGTRCIQVEITPTSSRISRNAVTSMSIRGHRWKRHGNTELTGQEELMEISEVDEGFYSRAASSTSQSGLSNSSHNCSNKPSIGKNHRRSGGSKTGGKEKETTGESCKDHFARKQTQRAQSENLELLSLKRLTLTTSQSLPKPSSHGLAKTAATVFSKSFEQVSGVTVPHNPSSAVGCGAGTDANRFSACSLQEEKLIYVSERTELPMKHQSGQQRPPSISITLSTD

SEQ ID NO: 29475 - protein, 100 aa, Homo sapiens
  Payload ID: 5755
  Gene Symbol: FAM126B
  Gene Name: family with sequence similarity 126, member B
  ENSP ID: ENSP00000286181
MLGTDRCVVEEWLSEFKALPDTQITSYAATLHRKKTLVPALYKVIQDSNNEIQPPRVPLLCTGVSLKKFSSWSLSAISCLSSIVAQRFDLRGSHCSSCQN

SEQ ID NO: 29476 - protein, 530 aa, Homo sapiens
  Payload ID: 5755
  Gene Symbol: FAM126B
  Gene Name: family with sequence similarity 126, member B
  Uniprot ID: Q8IXS8
  ENSP ID: ENSP00000393667
MLGTDRCVVEEWLSEFKALPDTQITSYAATLHRKKTLVPALYKVIQDSNNELLEPVCHQLFELYRSSEVRLKRFTLQFLPELMWVYLRLTVSRDRQSNGCIEALLLGIYNLEIADKDGNNKVLSFTIPSLSKPSIYHEPSTIGSMALTEGALCQHDLIRVVYSDLHPQRETFTAQNRFEVLSFLMLCYNSAIVYMPASSYQSLCRMGSRVCVSGFPRQHEKHWKELCGRIVLDPEFMVQLLTGVYYAMYNGQWDLGQEVLDDIIYRAQLELFSQPLLVANAMKNSLPFDAPDSTQEGQKVLKVEVTPTVPRISRTAITTASIRRHRWRREGAEGVNGGEESVNLNDADEGFSSGASLSSQPIGTKPSSSSQRGSLRKVATGRSAKDKETASAIKSSESPRDSVVRKQYVQQPTDLSVDSVELTPMKKHLSLPAGQVVPKINSLSLIRTASASSSKSFDYVNGSQASTSIGVGTEGGTNLAANNANRYSTVSLQEDRLGQAGEGKELLSPGAPLTKQSRSPSFNMQLISQV

SEQ ID NO: 29477 - protein, 208 aa, Homo sapiens
  Payload ID: 5755
  Gene Symbol: FAM126B
  Gene Name: family with sequence similarity 126, member B
  ENSP ID: ENSP00000401905
MLGTDRCVVEEWLSEFKALPDTQITSYAATLHRKKTLVPALYKVIQDSNNELLEPVCHQLFELYRSSEVRLKRFTLQFLPELMWVYLRLTVSRDRQSNGCIEALLLGIYNLEIADKDGNNKVLSFTIPSLSKPSIYHEPSTIGSMALTEGALCQHDLIRVVYSDLHPQRETFTAQNRFEVLSFLMLCYNSAIVYMPASSYQSLCRMGS

SEQ ID NO: 29478 - protein, 87 aa, Homo sapiens
  Payload ID: 5755
  Gene Symbol: FAM126B
  Gene Name: family with sequence similarity 126, member B
  ENSP ID: ENSP00000408374
MLGTDRCVVEEWLSEFKALPDTQITSYAATLHRKKTLVPALYKVIQDSNNELLEPVCHQLFELYRSSEVRLKRFTLQFLPELMWVYL

SEQ ID NO: 29479 - protein, 84 aa, Homo sapiens
  Payload ID: 5755
  Gene Symbol: FAM126B
  Gene Name: family with sequence similarity 126, member B
  ENSP ID: ENSP00000412139
MLGTDRCVVEEWLSEFKALPDTQITSYAATLHRKKTLVPALYKVIQDSNNEIQPPRVPLLCTGVSLKKFSSWSLSAISCLSSIV

SEQ ID NO: 29480 - protein, 113 aa, Homo sapiens
  Payload ID: 5756
  Gene Symbol: FAM127A
  Gene Name: family with sequence similarity 127, member A
  Uniprot ID: A6ZKI3
  ENSP ID: ENSP00000257013
MDGRVQLIKALLALPIRPATRRWRNPIPFPETFDGDTDRLPEFIVQTGSYMFVDENTFSSDALKVTFLITRLTGPALQWVIPYIKKESPLLNDYRGFLAEMKRVFGWEEDEDF

SEQ ID NO: 29481 - protein, 113 aa, Homo sapiens
  Payload ID: 5757
  Gene Symbol: FAM127B
  Gene Name: family with sequence similarity 127, member B
  Uniprot ID: Q9BWD3
  ENSP ID: ENSP00000375267
MDGRVQLMKALLAGPLRPAARRWRNPIPFPETFDGDTDRLPEFIVQTSSYMFVDENTFSNDALKVTFLITRLTGPALQWVIPYIRKESPLLNDYRGFLAEMKRVFGWEEDEDF

SEQ ID NO: 29482 - protein, 113 aa, Homo sapiens
  Payload ID: 5758
  Gene Symbol: FAM127C
  Gene Name: family with sequence similarity 127, member C
  Uniprot ID: Q17RB0
  ENSP ID: ENSP00000375268
MEGRVQLMKALLARPLRPAARRWRNPIPFPETFDGDTDRLPEFIVQTSSYMFVDENTFSNDALKVTFLITRLTGPALQWVIPYIKKESPLLSDYRGFLAEMKRVFGWEEDEDF

SEQ ID NO: 29483 - protein, 928 aa, Homo sapiens
  Payload ID: 5759
  Gene Symbol: FAM129A
  Gene Name: family with sequence similarity 129, member A
  Uniprot ID: Q9BZQ8
  ENSP ID: ENSP00000356481
MGGSASSQLDEGKCAYIRGKTEAAIKNFSPYYSRQYSVAFCNHVRTEVEQQRDLTSQFLKTKPPLAPGTILYEAELSQFSEDIKKWKERYVVVKNDYAVESYENKEAYQRGAAPKCRILPAGGKVLTSEDEYNLLSDRHFPDPLASSEKENTQPFVVLPKEFPVYLWQPFFRHGYFCFHEAADQKRFSALLSDCVRHLNHDYMKQMTFEAQAFLEAVQFFRQEKGHYGSWEMITGDEIQILSNLVMEELLPTLQTDLLPKMKGKKNDRKRTWLGLLEEAYTLVQHQVSEGLSALKEECRALTKGLEGTIRSDMDQIVNSKNYLIGKIKAMVAQPAEKSCLESVQPFLASILEELMGPVSSGFSEVRVLFEKEVNEVSQNFQTTKDSVQLKEHLDRLMNLPLHSVKMEPCYTKVNLLHERLQDLKSRFRFPHIDLVVQRTQNYMQELMENAVFTFEQLLSPHLQGEASKTAVAIEKVKLRVLKQYDYDSSTIRKKIFQEALVQITLPTVQKALASTCKPELQKYEQFIFADHTNMIHVENVYEEILHQILLDETLKVIKEAAILKKHNLFEDNMALPSESVSSLTDLKPPTGSNQASPARRASAILPGVLGSETLSNEVFQESEEEKQPEVPSSLAKGESLSLPGPSPPPDGTEQVIISRVDDPVVNPVATEDTAGLPGTCSSELEFGGTLEDEEPAQEEPEPITASGSLKALRKLLTASVEVPVDSAPVMEEDTNGESHVPQENEEEEEKEPSQAAAIHPDNCEESEVSEREAQPPCPEAHGEELGGFPEVGSPASPPASGGLTEEPLGPMEGELPGEACTLTAHEGRGGKCTEEGDASQQEGCTLGSDPICLSESQVSEEQEEMGGQSSAAQATASVNAEEIKVARIHECQWVVEDAPNPDVLLSHKDDVKEGEGGQESFPELPSEE

SEQ ID NO: 29484 - protein, 100 aa, Homo sapiens
  Payload ID: 5759
  Gene Symbol: FAM129A
  Gene Name: family with sequence similarity 129, member A
  ENSP ID: ENSP00000414039
  MOD_RES (1)..(1): Any amino acid
XAVAIEKVKLRVLKQYDYDSSTIRKKIFQEALVQITLPTVQKALASTCKPELQKYEQFIFADHTNMIHVENVYEEILHQILLDETLKGAYIPIKCSSLKS

SEQ ID NO: 29485 - protein, 746 aa, Homo sapiens
  Payload ID: 5760
  Gene Symbol: FAM129B
  Gene Name: family with sequence similarity 129, member B
  Uniprot ID: Q96TA1
  ENSP ID: ENSP00000362409
MGDVLSTHLDDARRQHIAEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 29486 - protein, 733 aa, Homo sapiens
  Payload ID: 5760
  Gene Symbol: FAM129B
  Gene Name: family with sequence similarity 129, member B
  Uniprot ID: Q96TA1
  ENSP ID: ENSP00000362411
MGWMGEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 29487 - protein, 651 aa, Homo sapiens
  Payload ID: 5761
  Gene Symbol: FAM129C
  Gene Name: family with sequence similarity 129, member C
  Uniprot ID: Q86XR2
  ENSP ID: ENSP00000333447
MGPDRKEVPLSRGTQAVVVGKGRGAPGDDSSMGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTLDGCLEVPWEQEGADEETEAEREGGACPRQPDSGAQIQPLCPPPSPGTFRS

SEQ ID NO: 29488 - protein, 697 aa, Homo sapiens
  Payload ID: 5761
  Gene Symbol: FAM129C
  Gene Name: family with sequence similarity 129, member C
  Uniprot ID: Q86XR2
  ENSP ID: ENSP00000335040
MGPDRKEVPLSRGTQAVVVGKGRGAPGDDSSMGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTLDGCLEVPWEQEGAAPNLNLVSSFLAGRQAFTDFLCLPAKSSANWILAASLLSCSCFRSGFHRDSRVFLVQLAEGLSHSLETVSSHSVWSFRPTPRQ

SEQ ID NO: 29489 - protein, 423 aa, Homo sapiens
  Payload ID: 5761
  Gene Symbol: FAM129C
  Gene Name: family with sequence similarity 129, member C
  Uniprot ID: Q86XR2
  ENSP ID: ENSP00000394929
MREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTLDGCLEVPWEQEGAAPNLNLVSSFLAGRQAFTDFLCLPAKSSANWILAASLLSCSCFRSGFHRDSRVFLVQLAEGLSHSLETVSSHSVWSFRPTPRQ

SEQ ID NO: 29490 - protein, 562 aa, Homo sapiens
  Payload ID: 5761
  Gene Symbol: FAM129C
  Gene Name: family with sequence similarity 129, member C
  ENSP ID: ENSP00000468994
MGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKTESHSVAQAVVQWCDLGSLQPPPPRFKRSSHLSLPSSWDYRHPL

SEQ ID NO: 29491 - protein, 620 aa, Homo sapiens
  Payload ID: 5761
  Gene Symbol: FAM129C
  Gene Name: family with sequence similarity 129, member C
  ENSP ID: ENSP00000469225
MGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTLDGCLEVPWEQEGADEETEAEREGGACPRQPDSGAQIQPLCPPPSPGTFRS

SEQ ID NO: 29492 - protein, 666 aa, Homo sapiens
  Payload ID: 5761
  Gene Symbol: FAM129C
  Gene Name: family with sequence similarity 129, member C
  Uniprot ID: Q86XR2
  ENSP ID: ENSP00000470106
MGPDRKEVPLSRGTQAVVVGKGRGAPGDDSSMGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTLDGCLEVPWEQEGAGGELHRLLKHASDCWGWGGGGPHGVYGIVMSVGSWTEQNALCLLTQPAWPSS

SEQ ID NO: 29493 - protein, 584 aa, Homo sapiens
  Payload ID: 5761
  Gene Symbol: FAM129C
  Gene Name: family with sequence similarity 129, member C
  ENSP ID: ENSP00000470798
MGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKELPEFEGDVLAVGSQALTTEGIYEDVIRGCLLQRIDQELKKTLGANDVSCTLDGCLEVPWEQEGADEETEAEREGGACPRQPDSGAQIQPLCPPPSPGTFRS

SEQ ID NO: 29494 - protein, 569 aa, Homo sapiens
  Payload ID: 5761
  Gene Symbol: FAM129C
  Gene Name: family with sequence similarity 129, member C
  ENSP ID: ENSP00000471117
MGGRPSSPLDKQQRQHLRGQVDTLLRNFLPCYRGQLAASKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQDEETEAEREGGACPRQPDSGAQIQPLCPPPSPGTFRS

SEQ ID NO: 29495 - protein, 666 aa, Homo sapiens
  Payload ID: 5761
  Gene Symbol: FAM129C
  Gene Name: family with sequence similarity 129, member C
  ENSP ID: ENSP00000471168
MGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGIVLQRSQAPAARAFLDAVRLYRQHQGHFGDDDVTLGSDAEVLTAVLMREQLPALRAQTLPGLRGAGRARAWAWTELLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKKFKSDSGLAQRRFIRGWGLCIFLPFVLSQLEPGCKKELPEFEGDVLAVGSQALTTEGIYEDVIRGCLLQRIDQELKKTLGANDVSCTLDGCLEVPWEQEGAAPNLNLVSSFLAGRQAFTDFLCLPAKSSANWILAASLLSCSCFRSGFHRDSRVFLVQLAEGLSHSLETVSSHSVWSFRPTPRQ

SEQ ID NO: 29496 - protein, 1023 aa, Homo sapiens
  Payload ID: 5762
  Gene Symbol: FAM13A
  Gene Name: family with sequence similarity 13, member A
  Uniprot ID: O94988
  ENSP ID: ENSP00000264344
MGAGALAICQSKAAVRLKEDMKKIVAVPLNEQKDFTYQKLFGVSLQELERQGLTENGIPAVVWNIVEYLTQHGLTQEGLFRVNGNVKVVEQLRLKFESGVPVELGKDGDVCSAASLLKLFLRELPDSLITSALQPRFIQLFQDGRNDVQESSLRDLIKELPDTHYCLLKYLCQFLTKVAKHHVQNRMNVHNLATVFGPNCFHVPPGLEGMKEQDLCNKIMAKILENYNTLFEVEYTENDHLRCENLARLIIVKEVYYKNSLPILLTRGLERDMPKPPPKTKIPKSRSEGSIQAHRVLQPELSDGIPQLSLRLSYRKACLEDMNSAEGAISAKLVPSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 29497 - protein, 669 aa, Homo sapiens
  Payload ID: 5762
  Gene Symbol: FAM13A
  Gene Name: family with sequence similarity 13, member A
  Uniprot ID: O94988
  ENSP ID: ENSP00000378450
MACEIMPLQSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 29498 - protein, 129 aa, Homo sapiens
  Payload ID: 5762
  Gene Symbol: FAM13A
  Gene Name: family with sequence similarity 13, member A
  ENSP ID: ENSP00000421269
MQPPVVNMTDCSFFLRSFKQSKAAVRLKEDMKKIVAVPLNEQKDFTYQKLFGVSLQELERQGLTENGIPAVVWNIVEYLTQHGLTQEGLFRVNGNVKVVEQLRLKFESGVPVELGKDGDVCSAASLLKL

SEQ ID NO: 29499 - protein, 697 aa, Homo sapiens
  Payload ID: 5762
  Gene Symbol: FAM13A
  Gene Name: family with sequence similarity 13, member A
  Uniprot ID: O94988
  ENSP ID: ENSP00000421562
MACEIMPLQSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 29500 - protein, 609 aa, Homo sapiens
  Payload ID: 5762
  Gene Symbol: FAM13A
  Gene Name: family with sequence similarity 13, member A
  ENSP ID: ENSP00000421914
MKEQDLCNKIMAKILENYNTLFEVEYTENDHLRCENLARLIIVKEVYYKNSLPILLTRGLERDMPKPPPKTKNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 29501 - protein, 202 aa, Homo sapiens
  Payload ID: 5762
  Gene Symbol: FAM13A
  Gene Name: family with sequence similarity 13, member A
  ENSP ID: ENSP00000422345
MGAGALAICQSKAAVRLKEDMKKIVAVPLNEQKDFTYQKLFGVSLQELERQGLTENGIPAVVWNIVEYLTQHGLTQEGLFRVNGNVKVVEQLRLKFESGVPVELGKDGDVCSAASLLKLFLRELPDSLITSALQPRFIQLFQDGRNDVQESSLRDLIKELPDTHYCLLKYLCQFLTKVAKHHVQNRMNVHNLATVFGPNCFQ

SEQ ID NO: 29502 - protein, 669 aa, Homo sapiens
  Payload ID: 5762
  Gene Symbol: FAM13A
  Gene Name: family with sequence similarity 13, member A
  Uniprot ID: O94988
  ENSP ID: ENSP00000423252
MACEIMPLQRLLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 29503 - protein, 150 aa, Homo sapiens
  Payload ID: 5762
  Gene Symbol: FAM13A
  Gene Name: family with sequence similarity 13, member A
  ENSP ID: ENSP00000423800
MGAGALAICQSKAAVRLKEDMKKIVAVPLNEQKDFTYQKLFGVSLQELERQGLTENGIPAVVWNIVEYLTQHGLTQEGLFRVNGNVKVVEQLRLKFESGVPVELGKDGDVCSAASLLKLFLRELPDSLITSALQPRFIQLFQVCHLGLKA

SEQ ID NO: 29504 - protein, 163 aa, Homo sapiens
  Payload ID: 5762
  Gene Symbol: FAM13A
  Gene Name: family with sequence similarity 13, member A
  ENSP ID: ENSP00000425784
MACEIMPLQSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVERK

SEQ ID NO: 29505 - protein, 277 aa, Homo sapiens
  Payload ID: 5762
  Gene Symbol: FAM13A
  Gene Name: family with sequence similarity 13, member A
  ENSP ID: ENSP00000426517
MGAGALAICQSKAAVRLKEDMKKIVAVPLNEQKDFTYQKLFGVSLQELERQGLTENGIPAVVWNIVEYLTQHGLTQEGLFRVNGNVKVVEQLRLKFESGVPVELGKDGDVCSAASLLKLFLRELPDSLITSALQPRFIQLFQDGRNDVQESSLRDLIKELPDTHYCLLKYLCQFLTKVAKHHVQNRMNVHNLATVFGPNCFHVPPGLEGMKEQDLCNKIMAKILENYNTLFEVEYTENDHLRCENLARLIIVKVSNLVFNFQYCYNFGQKILFNSFS

SEQ ID NO: 29506 - protein, 186 aa, Homo sapiens
  Payload ID: 5762
  Gene Symbol: FAM13A
  Gene Name: family with sequence similarity 13, member A
  ENSP ID: ENSP00000427077
MACEIMPLQSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFE

SEQ ID NO: 29507 - protein, 683 aa, Homo sapiens
  Payload ID: 5762
  Gene Symbol: FAM13A
  Gene Name: family with sequence similarity 13, member A
  Uniprot ID: O94988
  ENSP ID: ENSP00000427189
MACEIMPLQSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 29508 - protein, 915 aa, Homo sapiens
  Payload ID: 5763
  Gene Symbol: FAM13B
  Gene Name: family with sequence similarity 13, member B
  Uniprot ID: Q9NYF5
  ENSP ID: ENSP00000033079
MRKSSSPSLSNCNSVLANKIFGIPLDELQQGGHPDNEVPFIVRHVVDYIEEHGGLEQQGLFQVNGNAETVEWLRQRYDSGEEVDLVKEADVPSAISLLRFFLQELPEPVIPGSLHIHLMQLSQDYNNEDEFGRKLRFLLQQLPPVNYSLLKFLCRFLANVASHHEEIWSANSLAAVFGPDVFHIYTDVEDMKEQEIVSRIMAGLLENYYEFFENEEEDFSSNDLSSITEQVNELSEEEEEDEKLEHIEELPEEGAEKSNDMPEVVQLRMTENILESNSVTATSTHISPISILPASTDILERTIRAAVEQHLFDLQSSIDHDLKNLQQQSVVCNNEAESIHCDGEGSNNQIDIADDIINASESNRDCSKPVASTNLDNEAMQQDCVFENEENTQSVGILLEPCSDRGDSEDGCLEREEYLLFDSDKLSHLILDSSSKICDLNANTESEVPGGQSVGVQGEAACVSIPHLDLKNVSDGDKWEEPFPAFKSWQEDSESGEAQLSPQAGRMNHHPLEEDCPPVLSHRSLDFGQSQRFLHDPEKLDSSSKALSFTRIRRSSFSSKDEKREDRTPYQLVKKLQKKIRQFEEQFERERNSKPSYSDIAANPKVLKWMTELTKLRKQIKDAKHKNSDGEFVPQTRPRSNTLPKSFGSSLDHEDEENEDEPKVIQKEKKPSKEATLELILKRLKEKRIERCLPEDIKKMTKDHLVEEKASLQKSLLYYESQHGRPVTKEERHIVKPLYDRYRLVKQMLTRASITPVLGSPSTKRRGQMLQPIIEGETAHFFEEIKEEEEDGVNLSSELGDMLKTAVQVQSSLENSESDVEENQEKLALDLRLSSSRAASMPELLEQLWKARAEKKKLRKTLREFEEAFYQQNGRNAQKEDRVPVLEEYREYKKIKAKLRLLEVLISKQDSSKSI

SEQ ID NO: 29509 - protein, 887 aa, Homo sapiens
  Payload ID: 5763
  Gene Symbol: FAM13B
  Gene Name: family with sequence similarity 13, member B
  Uniprot ID: Q9NYF5
  ENSP ID: ENSP00000388521
MRKSSSPSLSNCNSVLANKIFGIPLDELQQGGHPDNEVPFIVRHVVDYIEEHGGLEQQGLFQVNGNAETVEWLRQRYDSGEEVDLVKEADVPSAISLLRFFLQELPEPVIPGSLHIHLMQLSQDYNNEDEFGRKLRFLLQQLPPVNYSLLKFLCRFLANVASHHEEIWSANSLAAVFGPDVFHIYTDVEDMKEQEIVSRIMAGLLENYYEFFENEEEDFSSNDLSSITEQVNELSEEEEEDEKLEHIEELPEEGAEKSNDMPEVVQLRMTENILESNSVTATSTHISPISILPASTDILERTIRAAVEQHLFDLQSSIDHDLKNLQQQSVVCNNEAESIHCDGEGSNNQIDIADDIINASESNRDCSKPVASTNLDNEAMQQDCVFENEENTQSVGILLEPCSDRGDSEDGCLEREEYLLFDSDKLSHLILDSSSKICDLNANTESEVPGGQSVGVQGEAACVSIPHLDLKNVSDGDKWEEPFPAFKSWQEDSESGEAQLSPQAGRMNHHPLEEDCPPVLSHRSLDFGQSQRFLHDPEKLDSSSKALSFTRIRRSSFSSKDEKREDRTPYQLVKKLQKKIRQFEEQFERERNSKPSYSDIAANPKVLKWMTELTKLRKQIKDAKHKNSDGEFVPQTRPRSNTLPKSFGSSLDHEDEENEDEPKVIQKEKKPSKEATLELILKRLKEKRIERCLPEDIKVTKEERHIVKPLYDRYRLVKQMLTRASITPVLGSPSTKRRGQMLQPIIEGETAHFFEEIKEEEEDGVNLSSELGDMLKTAVQVQSSLENSESDVEENQEKLALDLRLSSSRAASMPELLEQLWKARAEKKKLRKTLREFEEAFYQQNGRNAQKEDRVPVLEEYREYKKIKAKLRLLEVLISKQDSSKSI

SEQ ID NO: 29510 - protein, 791 aa, Homo sapiens
  Payload ID: 5763
  Gene Symbol: FAM13B
  Gene Name: family with sequence similarity 13, member B
  Uniprot ID: Q9NYF5
  ENSP ID: ENSP00000394669
MQLSQDYNNEDEFGRKLRFLLQQLPPVNYSLLKFLCRFLANVASHHEEIWSANSLAAVFGPDVFHIYTDVEDMKEQEIVSRIMAGLLENYYEFFENEEEDFSSNDLSSITEQVNELSEEEEEDEKLEHIEELPEEGAEKSNDMPEVVQLRMTENILESNSVTATSTHISPISILPASTDILERTIRAAVEQHLFDLQSSIDHDLKNLQQQSVVCNNEAESIHCDGEGSNNQIDIADDIINASESNRDCSKPVASTNLDNEAMQQDCVFENEENTQSVGILLEPCSDRGDSEDGCLEREEYLLFDSDKLSHLILDSSSKICDLNANTESEVPGGQSVGVQGEAACVSIPHLDLKNVSDGDKWEASCPITFPLIDFKTMHLQRDGEEPFPAFKSWQEDSESGEAQLSPQAGRMNHHPLEEDCPPVLSHRSLDFGQSQRFLHDPEKLDSSSKALSFTRIRRSSFSSKDEKREDRTPYQLVKKLQKKIRQFEEQFERERNSKPSYSDIAANPKVLKWMTELTKLRKQIKDAKHKNSDGEFVPQTRPRSNTLPKSFGSSLDHEDEENEDEPKVIQKEKKPSKEATLELILKRLKEKRIERCLPEDIKVTKEERHIVKPLYDRYRLVKQMLTRASITPVLGSPSTKRRGQMLQPIIEGETAHFFEEIKEEEEDGVNLSSELGDMLKTAVQVQSSLENSESDVEENQEKLALDLRLSSSRAASMPELLEQLWKARAEKKKLRKTLREFEEAFYQQNGRNAQKEDRVPVLEEYREYKKIKAKLRLLEVLISKQDSSKSI

SEQ ID NO: 29511 - protein, 87 aa, Homo sapiens
  Payload ID: 5763
  Gene Symbol: FAM13B
  Gene Name: family with sequence similarity 13, member B
  ENSP ID: ENSP00000422311
MRKSSSPSLSNCNSVLANKIFGIPLDELQQGGHPDNEVPFIVRHVVDYIEEHGGLEQQGLFQVNGNAETVEWLRQRYDSGEEVDLVK

SEQ ID NO: 29512 - protein, 52 aa, Homo sapiens
  Payload ID: 5763
  Gene Symbol: FAM13B
  Gene Name: family with sequence similarity 13, member B
  ENSP ID: ENSP00000422673
MRKSSSPSLSNCNSVLANKIFGIPLDELQQGGHPDNEVPFIVRHVVDYIEEH

SEQ ID NO: 29513 - protein, 95 aa, Homo sapiens
  Payload ID: 5763
  Gene Symbol: FAM13B
  Gene Name: family with sequence similarity 13, member B
  ENSP ID: ENSP00000424785
MRKSSSPSLSNCNSVLANKIFGIPLDELQQGGHPDNEVPFIVRHVVDYIEEHGGLEQQGLFQVNGNAETVEWLRQRYDSGEEVDLVKEADVPSAI

SEQ ID NO: 29514 - protein, 142 aa, Homo sapiens
  Payload ID: 5763
  Gene Symbol: FAM13B
  Gene Name: family with sequence similarity 13, member B
  ENSP ID: ENSP00000425326
MRKSSSPSLSNCNSVLANKIFGIPLDELQQGGHPDNEVPFIVRHVVDYIEEHGGLEQQGLFQVNGNAETVEWLRQRYDSGEEVDLVKEADVPSAISLLRFFLQELPEPVIPGSLHIHLMQLSQDYNNEDEFGRKLRFLLQQL

SEQ ID NO: 29515 - protein, 64 aa, Homo sapiens
  Payload ID: 5763
  Gene Symbol: FAM13B
  Gene Name: family with sequence similarity 13, member B
  ENSP ID: ENSP00000426863
MRKSSSPSLSNCNSVLANKIFGIPLDELQQGGHPDNEVPFIVRHVVDYIEEHGGLEQQGLFQVN

SEQ ID NO: 29516 - protein, 573 aa, Homo sapiens
  Payload ID: 5764
  Gene Symbol: FAM13C
  Gene Name: family with sequence similarity 13, member C
  ENSP ID: ENSP00000392302
MFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRYVSAERFLKLILPRELLLKMSCNFLQER

SEQ ID NO: 29517 - protein, 458 aa, Homo sapiens
  Payload ID: 5764
  Gene Symbol: FAM13C
  Gene Name: family with sequence similarity 13, member C
  Uniprot ID: Q8NE31
  ENSP ID: ENSP00000400241
MFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIVSQDTCMLLLCTDV

SEQ ID NO: 29518 - protein, 502 aa, Homo sapiens
  Payload ID: 5764
  Gene Symbol: FAM13C
  Gene Name: family with sequence similarity 13, member C
  Uniprot ID: Q8NE31
  ENSP ID: ENSP00000423896
MGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 29519 - protein, 5 aa, Homo sapiens
  Payload ID: 5764
  Gene Symbol: FAM13C
  Gene Name: family with sequence similarity 13, member C
  ENSP ID: ENSP00000424797
MGNFK

SEQ ID NO: 29520 - protein, 25 aa, Homo sapiens
  Payload ID: 5764
  Gene Symbol: FAM13C
  Gene Name: family with sequence similarity 13, member C
  ENSP ID: ENSP00000425820
MGNFKSRKPKSIFKAESGRSHGESQ

SEQ ID NO: 29521 - protein, 134 aa, Homo sapiens
  Payload ID: 5764
  Gene Symbol: FAM13C
  Gene Name: family with sequence similarity 13, member C
  ENSP ID: ENSP00000445068
SRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKGKSQPKIFFPHKGSS

SEQ ID NO: 29522 - protein, 501 aa, Homo sapiens
  Payload ID: 5764
  Gene Symbol: FAM13C
  Gene Name: family with sequence similarity 13, member C
  Uniprot ID: Q8NE31
  ENSP ID: ENSP00000480677
MGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 29523 - protein, 487 aa, Homo sapiens
  Payload ID: 5764
  Gene Symbol: FAM13C
  Gene Name: family with sequence similarity 13, member C
  Uniprot ID: Q8NE31
  ENSP ID: ENSP00000481830
MFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 29524 - protein, 585 aa, Homo sapiens
  Payload ID: 5764
  Gene Symbol: FAM13C
  Gene Name: family with sequence similarity 13, member C
  Uniprot ID: Q8NE31
  ENSP ID: ENSP00000481854
MFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 29525 - protein, 606 aa, Homo sapiens
  Payload ID: 5764
  Gene Symbol: FAM13C
  Gene Name: family with sequence similarity 13, member C
  ENSP ID: ENSP00000483510
MFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNENSLLKLQALESDLCSAFLTNQEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 29526 - protein, 49 aa, Homo sapiens
  Payload ID: 5764
  Gene Symbol: FAM13C
  Gene Name: family with sequence similarity 13, member C
  ENSP ID: ENSP00000484217
  MOD_RES (1)..(1): Any amino acid
XRTAISPKDAFETRQDLNEEEAAQVHGVKDPAPASTQSVLADGTDSAGN

SEQ ID NO: 29527 - protein, 50 aa, Homo sapiens
  Payload ID: 5764
  Gene Symbol: FAM13C
  Gene Name: family with sequence similarity 13, member C
  ENSP ID: ENSP00000484539
MFSCFCFSLQDNSFSSTTVTEPERRGERCAKVCICRPKMRPGLPAPGAQV

SEQ ID NO: 29528 - protein, 605 aa, Homo sapiens
  Payload ID: 5764
  Gene Symbol: FAM13C
  Gene Name: family with sequence similarity 13, member C
  ENSP ID: ENSP00000484625
MFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNENSLLKLQALESDLCSAFLTNQEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 29529 - protein, 50 aa, Homo sapiens; identical to SEQ ID NO: 29527
  Payload ID: 5764
  Gene Symbol: FAM13C
  Gene Name: family with sequence similarity 13, member C
  ENSP ID: ENSP00000484965

SEQ ID NO: 29530 - protein, 335 aa, Homo sapiens
  Payload ID: 5765
  Gene Symbol: FAM131A
  Gene Name: family with sequence similarity 131, member A
  Uniprot ID: Q6UXB0
  ENSP ID: ENSP00000310135
MFLATLSFLLPFAHPFGTVSCEYMLGSPLSSLAQVNLSPFSHPKVHMDPNYCHPSTSLHLCSLAWSFTRLLHPPLSPGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 29531 - protein, 281 aa, Homo sapiens
  Payload ID: 5765
  Gene Symbol: FAM131A
  Gene Name: family with sequence similarity 131, member A
  Uniprot ID: Q6UXB0
  ENSP ID: ENSP00000340974
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 29532 - protein, 366 aa, Homo sapiens
  Payload ID: 5765
  Gene Symbol: FAM131A
  Gene Name: family with sequence similarity 131, member A
  Uniprot ID: Q6UXB0
  ENSP ID: ENSP00000373360
MPMISVLGKMFLWQREGPGGRWTCQTSRRVSSDPAWAVEWIELPRGLSLSSLGSARTLRGWSRSSRPSSVDSQDLPEVNVGDTVAMLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 29533 - protein, 281 aa, Homo sapiens; identical to SEQ ID NO: 29531
  Payload ID: 5765
  Gene Symbol: FAM131A
  Gene Name: family with sequence similarity 131, member A
  Uniprot ID: Q6UXB0
  ENSP ID: ENSP00000388551

SEQ ID NO: 29534 - protein, 281 aa, Homo sapiens; identical to SEQ ID NO: 29531
  Payload ID: 5765
  Gene Symbol: FAM131A
  Gene Name: family with sequence similarity 131, member A
  Uniprot ID: Q6UXB0
  ENSP ID: ENSP00000390588

SEQ ID NO: 29535 - protein, 123 aa, Homo sapiens
  Payload ID: 5765
  Gene Symbol: FAM131A
  Gene Name: family with sequence similarity 131, member A
  ENSP ID: ENSP00000399875
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDT

SEQ ID NO: 29536 - protein, 251 aa, Homo sapiens
  Payload ID: 5765
  Gene Symbol: FAM131A
  Gene Name: family with sequence similarity 131, member A
  ENSP ID: ENSP00000414050
MAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTEGWLLPSRSLWVEPSLKGPCPAGLVLCFIHLSIVSKSSSFFLKTEGFWSVFSVGSSLLWEALE

SEQ ID NO: 29537 - protein, 231 aa, Homo sapiens
  Payload ID: 5765
  Gene Symbol: FAM131A
  Gene Name: family with sequence similarity 131, member A
  ENSP ID: ENSP00000414913
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLS

SEQ ID NO: 29538 - protein, 11 aa, Homo sapiens
  Payload ID: 5766
  Gene Symbol: FAM131B
  Gene Name: family with sequence similarity 131, member B
  ENSP ID: ENSP00000386396
  MOD_RES (1)..(1): Any amino acid
XDFSWDGINAL

SEQ ID NO: 29539 - protein, 348 aa, Homo sapiens
  Payload ID: 5766
  Gene Symbol: FAM131B
  Gene Name: family with sequence similarity 131, member B
  Uniprot ID: Q86XD5
  ENSP ID: ENSP00000386568
MGCIGSRTVGNEVIAVDWKGLKDVDQINMDSTSSLHGSSLHRPSTELSMEDTTSILPKLKRNSNAYGIGALAKSSFSGISRSMKDHVTKPTAMGQGRVAHMIEWQGWGKTPAVQPQHSHESVRRDTDAYSDLSDGEKEARFLAGVMEQFAISEATLMAWSSMDGEDMSVNSTQEPLGCNYSDNYQELMDSQDALAQAPMDGWPHSYVSQGMYCLGSSDAWEASDQSLIASPATGSYLGPAFDDSQPSLHEMGPSQPASGYSALEPPPLLGGDTDWAPGVGAVDLARGPAEEEKRPLAPEEEEDAGCRDLESLSPREDPEMSTALSRKVSDVTSSGVQSFDEEEGEANN

SEQ ID NO: 29540 - protein, 332 aa, Homo sapiens
  Payload ID: 5766
  Gene Symbol: FAM131B
  Gene Name: family with sequence similarity 131, member B
  Uniprot ID: Q86XD5
  ENSP ID: ENSP00000386984
MDSTSSLHGSSLHRPSTEQTRTDFSWDGINLSMEDTTSILPKLKRNSNAYGIGALAKSSFSGISRSMKDHVTKPTAMGQGRVAHMIEWQGWGKTPAVQPQHSHESVRRDTDAYSDLSDGEKEARFLAGVMEQFAISEATLMAWSSMDGEDMSVNSTQEPLGCNYSDNYQELMDSQDALAQAPMDGWPHSYVSQGMYCLGSSDAWEASDQSLIASPATGSYLGPAFDDSQPSLHEMGPSQPASGYSALEPPPLLGGDTDWAPGVGAVDLARGPAEEEKRPLAPEEEEDAGCRDLESLSPREDPEMSTALSRKVSDVTSSGVQSFDEEEGEANN

SEQ ID NO: 29541 - protein, 332 aa, Homo sapiens; identical to SEQ ID NO: 29540
  Payload ID: 5766
  Gene Symbol: FAM131B
  Gene Name: family with sequence similarity 131, member B
  Uniprot ID: Q86XD5
  ENSP ID: ENSP00000387017

SEQ ID NO: 29542 - protein, 332 aa, Homo sapiens; identical to SEQ ID NO: 29540
  Payload ID: 5766
  Gene Symbol: FAM131B
  Gene Name: family with sequence similarity 131, member B
  Uniprot ID: Q86XD5
  ENSP ID: ENSP00000387147

SEQ ID NO: 29543 - protein, 360 aa, Homo sapiens
  Payload ID: 5766
  Gene Symbol: FAM131B
  Gene Name: family with sequence similarity 131, member B
  Uniprot ID: Q86XD5
  ENSP ID: ENSP00000410603
MGCIGSRTVGNEVIAVDWKGLKDVDQINMDSTSSLHGSSLHRPSTEQTRTDFSWDGINLSMEDTTSILPKLKRNSNAYGIGALAKSSFSGISRSMKDHVTKPTAMGQGRVAHMIEWQGWGKTPAVQPQHSHESVRRDTDAYSDLSDGEKEARFLAGVMEQFAISEATLMAWSSMDGEDMSVNSTQEPLGCNYSDNYQELMDSQDALAQAPMDGWPHSYVSQGMYCLGSSDAWEASDQSLIASPATGSYLGPAFDDSQPSLHEMGPSQPASGYSALEPPPLLGGDTDWAPGVGAVDLARGPAEEEKRPLAPEEEEDAGCRDLESLSPREDPEMSTALSRKVSDVTSSGVQSFDEEEGEANN

SEQ ID NO: 29544 - protein, 63 aa, Homo sapiens
  Payload ID: 5766
  Gene Symbol: FAM131B
  Gene Name: family with sequence similarity 131, member B
  ENSP ID: ENSP00000430601
MGCIGSRTVGNEVIAVDWKGLKDVDQINMDSTSSLHGSSLHRPSTEQTRTDFSWDGINGSHGA

SEQ ID NO: 29545 - protein, 44 aa, Homo sapiens
  Payload ID: 5766
  Gene Symbol: FAM131B
  Gene Name: family with sequence similarity 131, member B
  ENSP ID: ENSP00000430805
MDSTSSLHGSSLHRPSTEQTRTDFSWDGINLECFFLETMNLLHV

SEQ ID NO: 29546 - protein, 280 aa, Homo sapiens
  Payload ID: 5767
  Gene Symbol: FAM131C
  Gene Name: family with sequence similarity 131, member C
  Uniprot ID: Q96AQ9
  ENSP ID: ENSP00000364814
MGSCVSRDLFTSAHKNCPMPQGADPLNPDLPSGRTPTVAPDCVIGKDKQMDFCWDPWQRCFQTTNGYLSDSRSRPGNYNVAALATSSLVGVVQSIKDHITKPTAMARGRVAHLIEWKGWSAQPAGWELSPAEDEHYCCLPDELREARFAAGVAEQFAITEATLSAWSSLDEEELHPENSPQGIVQLQDLESIYLQDSLPSGPSQDDSLQAFSSPSPSPDSCPSPEEPPSTAGIPQPPSPELQHRRRLPGAQGPEGGTHPPGSLPSMDSGSLWEEDEVFYN

SEQ ID NO: 29547 - protein, 302 aa, Homo sapiens
  Payload ID: 5768
  Gene Symbol: FAM132A
  Gene Name: family with sequence similarity 132, member A
  Uniprot ID: Q5T7M4
  ENSP ID: ENSP00000329137
MRRWAWAAVVVLLGPQLVLLGGVGARREAQRTQQPGQRADPPNATASASSREGLPEAPKPSQASGPEFSDAHMTWLNFVRRPDDGALRKRCGSRDKKPRDLFGPPGPPGAEVTAETLLHEFQELLKEATERRFSGLLDPLLPQGAGLRLVGEAFHCRLQGPRRVDKRTLVELHGFQAPAAQGAFLRGSGLSLASGRFTAPVSGIFQFSASLHVDHSELQGKARLRARDVVCVLICIESLCQRHTCLEAVSGLESNSRVFTLQVQGLLQLQAGQYASVFVDNGSGAVLTIQAGSSFSGLLLGT

SEQ ID NO: 29548 - protein, 74 aa, Homo sapiens
  Payload ID: 5769
  Gene Symbol: FAM132B
  Gene Name: family with sequence similarity 132, member B
  ENSP ID: ENSP00000343261
  MOD_RES (1)..(1): Any amino acid
XIQSRCQRNASLEAIMGLESSSELFTISVNGVLYLQATKNLVPQDLLGAKLVWQGRSGLGEKGAMASHLHLLTN

SEQ ID NO: 29549 - protein, 63 aa, Homo sapiens
  Payload ID: 5769
  Gene Symbol: FAM132B
  Gene Name: family with sequence similarity 132, member B
  ENSP ID: ENSP00000349855
  MOD_RES (1)..(1): Any amino acid
XFGYSSLEAIMGLESSSELFTISVNGVLYLQMGQWTSVFLDNASGCSLTVRSGSHFSAVLLGV

SEQ ID NO: 29550 - protein, 354 aa, Homo sapiens
  Payload ID: 5769
  Gene Symbol: FAM132B
  Gene Name: family with sequence similarity 132, member B
  Uniprot ID: Q4G0M1
  ENSP ID: ENSP00000442304
MAPARRPAGARLLLVYAGLLAAAAAGLGSPEPGAPSRSRARREPPPGNELPRGPGESRAGPAARPPEPTAERAHSVDPRDAWMLFVRQSDKGVNGKKRSRGKAKKLKFGLPGPPGPPGPQGPPGPIIPPEALLKEFQLLLKGAVRQRERAEPEPCTCGPAGPVAASLAPVSATAGEDDDDVVGDVLALLAAPLAPGPRAPRVEAAFLCRLRRDALVERRALHELGVYYLPDAEGAFRRGPGLNLTSGQYRAPVAGFYALAATLHVALGEPPRRGPPRPRDHLRLLICIQSRCQRNASLEAIMGLESSSELFTISVNGVLYLQMGQWTSVFLDNASGCSLTVRSGSHFSAVLLGV

SEQ ID NO: 29551 - protein, 248 aa, Homo sapiens
  Payload ID: 5770
  Gene Symbol: FAM133A
  Gene Name: family with sequence similarity 133, member A
  Uniprot ID: Q8N9E0
  ENSP ID: ENSP00000318974
MGKRDNRVAYMNPIAMARWRGPTQSVGPTIQDYLNRPRPTWEEVKKQLENKKTGSKALAEFEEKMNENWKKELEKSREKLLSGNESSSKKRERKKKRKKKSCRSSSSSSSSDSSSSSSDSEDEEKKQGKRRKKKKNRSYKSSQSSTHESESESKESVKKKKKSKDETEKEKDVRSLSKKRKKSYPDDKPLSSESSSESDYEEDVQAKKKRRCEEREQAKEKVKKKKKKQHKKHSKKKKKKSGSSHKSR

SEQ ID NO: 29552 - protein, 248 aa, Homo sapiens; identical to SEQ ID NO: 29551
  Payload ID: 5770
  Gene Symbol: FAM133A
  Gene Name: family with sequence similarity 133, member A
  Uniprot ID: Q8N9E0
  ENSP ID: ENSP00000362169

SEQ ID NO: 29553 - protein, 105 aa, Homo sapiens
  Payload ID: 5771
  Gene Symbol: FAM133B
  Gene Name: family with sequence similarity 133, member B
  ENSP ID: ENSP00000389559
MGKRDNRVAYMNPIAMARSRGPIQSSGPTIQDYLNRPRPTWEEVKEQLEKKKKGSKALAEFEEKMNENWKKELEKHREKLLSGSESSSKKRQRKKKEKKKSGRFF

SEQ ID NO: 29554 - protein, 237 aa, Homo sapiens
  Payload ID: 5771
  Gene Symbol: FAM133B
  Gene Name: family with sequence similarity 133, member B
  Uniprot ID: Q5BKY9
  ENSP ID: ENSP00000389783
MNPIAMARSRGPIQSSGPTIQDYLNRPRPTWEEVKEQLEKKKKGSKALAEFEEKMNENWKKELEKHREKLLSGSESSSKKRQRKKKEKKKSGRYSSSSSSSSDSSSSSSDSEDEDKKQGKRRKKKKNRSHKSSESSMSETESDSKDSLKKKKKSKDGTEKEKDIKGLSKKRKMYSEDKPLSSESLSESEYIEEVRAKKKKSSEEREKATEKTKKKKKHKKHSKKKKKKAASSSPDSP

SEQ ID NO: 29555 - protein, 247 aa, Homo sapiens
  Payload ID: 5771
  Gene Symbol: FAM133B
  Gene Name: family with sequence similarity 133, member B
  Uniprot ID: Q5BKY9
  ENSP ID: ENSP00000398401
MGKRDNRVAYMNPIAMARSRGPIQSSGPTIQDYLNRPRPTWEEVKEQLEKKKKGSKALAEFEEKMNENWKKELEKHREKLLSGSESSSKKRQRKKKEKKKSGRYSSSSSSSSDSSSSSSDSEDEDKKQGKRRKKKKNRSHKSSESSMSETESDSKDSLKKKKKSKDGTEKEKDIKGLSKKRKMYSEDKPLSSESLSESEYIEEVRAKKKKSSEEREKATEKTKKKKKHKKHSKKKKKKAASSSPDSP

SEQ ID NO: 29556 - protein, 237 aa, Homo sapiens; identical to SEQ ID NO: 29554
  Payload ID: 5771
  Gene Symbol: FAM133B
  Gene Name: family with sequence similarity 133, member B
  Uniprot ID: Q5BKY9
  ENSP ID: ENSP00000402843

SEQ ID NO: 29557 - protein, 30 aa, Homo sapiens
  Payload ID: 5771
  Gene Symbol: FAM133B
  Gene Name: family with sequence similarity 133, member B
  ENSP ID: ENSP00000407458
MNPIAMARSRGPIQSSGPTIQDYLNRPRPT

SEQ ID NO: 29558 - protein, 120 aa, Homo sapiens
  Payload ID: 5771
  Gene Symbol: FAM133B
  Gene Name: family with sequence similarity 133, member B
  ENSP ID: ENSP00000446324
YSSSSSSSSDSSSSSSDSEDEDKKQGKRRKKKKNRSHKSSESSMSETESDSKDSLKKKKKSKDGTEKEKDIKGLSKKRKMYSEDKPLSSESLSESEYIEEVRAKKKKSSEEREKATASIS

SEQ ID NO: 29559 - protein, 178 aa, Homo sapiens
  Payload ID: 5772
  Gene Symbol: FAM134A
  Gene Name: family with sequence similarity 134, member A
  ENSP ID: ENSP00000273048
MASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDRFTCRSCCSTRGRIQLSSAFESALAVLCWLCWDTMFQGL

SEQ ID NO: 29560 - protein, 94 aa, Homo sapiens
  Payload ID: 5772
  Gene Symbol: FAM134A
  Gene Name: family with sequence similarity 134, member A
  ENSP ID: ENSP00000391284
MISYIVLLSILLWPLVVYHELIQRMYTRLEPLLMQLDYSMKAEANALHHKHDKRKRQGKNAPPGGDEPLAETESESEAELAGFSPVVDVKKTAL

SEQ ID NO: 29561 - protein, 102 aa, Homo sapiens
  Payload ID: 5772
  Gene Symbol: FAM134A
  Gene Name: family with sequence similarity 134, member A
  ENSP ID: ENSP00000394606
MASGGGGGNTGAGGGPGMGLSLGLGLGLSLGMSEATSEAEEEAATAEAVGRLATTLWLRLRGWEAVLAAAQRLLVWEKPLHSLVTAAALNGLFCIIPRGATL

SEQ ID NO: 29562 - protein, 543 aa, Homo sapiens
  Payload ID: 5772
  Gene Symbol: FAM134A
  Gene Name: family with sequence similarity 134, member A
  Uniprot ID: Q8NC44
  ENSP ID: ENSP00000395249
MASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFQIHLQELLQYKRQNPAQFCVRVCSGCAVLAVLGHYVPGIMISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEGELAPPEDLLGRPQALSRQALDSEEEEEDVAAKETLLRLSSPLHFVNTHFNGAGSPPDGVKCSPGGPVETLSPETVSGGLTALPGTLSPPLCLVGSDPAPSPSILPPVPQDSPQPLPAPEEEEALTTEDFELLDQGELEQLNAELGLEPETPPKPPDAPPLGPDIHSLVQSDQEAQAVAEP

SEQ ID NO: 29563 - protein, 5 aa, Homo sapiens
  Payload ID: 5772
  Gene Symbol: FAM134A
  Gene Name: family with sequence similarity 134, member A
  ENSP ID: ENSP00000399261
MISYI

SEQ ID NO: 29564 - protein, 167 aa, Homo sapiens
  Payload ID: 5772
  Gene Symbol: FAM134A
  Gene Name: family with sequence similarity 134, member A
  ENSP ID: ENSP00000403898
MISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEGELAPPEDLLGR

SEQ ID NO: 29565 - protein, 203 aa, Homo sapiens
  Payload ID: 5772
  Gene Symbol: FAM134A
  Gene Name: family with sequence similarity 134, member A
  ENSP ID: ENSP00000411247
  MOD_RES (1)..(1): Any amino acid
XDSELSDEEASILESGGFSVSRATTPQLTDVSEDLDQQSLPSEPEETLSRDLGEGEEGELAPPEDLLGRPQALSRQALDSEEEEEDVAAKETLLRLSSPLHFVNTHFNGAGSPPDGVKCSPGGPVETLSPETDSPQPLPAPEEEEALTTEDFELLDQGELEQLNAELGLEPETPPKPPDAPPLGPDIHSLVQSDQEAQAVAEP

SEQ ID NO: 29566 - protein, 5 aa, Homo sapiens
  Payload ID: 5772
  Gene Symbol: FAM134A
  Gene Name: family with sequence similarity 134, member A
  ENSP ID: ENSP00000414547
MISYI

SEQ ID NO: 29567 - protein, 497 aa, Homo sapiens
  Payload ID: 5773
  Gene Symbol: FAM134B
  Gene Name: family with sequence similarity 134, member B
  Uniprot ID: Q9H6L5
  ENSP ID: ENSP00000304642
MASPAPPEHAEEGCPAPAAEEQAPPSPPPPQASPAERQQQEEEAQEAGAAEGAGLQVEEAAGRAAAAVTWLLGEPVLWLGCRADELLSWKRPLRSLLGFVAANLLFWFLALTPWRVYHLISVMILGRVIMQIIKDMVLSRTRGAQLWRSLSESWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 29568 - protein, 356 aa, Homo sapiens
  Payload ID: 5773
  Gene Symbol: FAM134B
  Gene Name: family with sequence similarity 134, member B
  Uniprot ID: Q9H6L5
  ENSP ID: ENSP00000382691
MPEGEDFGPGKSWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 29569 - protein, 217 aa, Homo sapiens
  Payload ID: 5773
  Gene Symbol: FAM134B
  Gene Name: family with sequence similarity 134, member B
  ENSP ID: ENSP00000425089
  MOD_RES (1)..(1): Any amino acid
XELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 29570 - protein, 466 aa, Homo sapiens
  Payload ID: 5774
  Gene Symbol: FAM134C
  Gene Name: family with sequence similarity 134, member C
  Uniprot ID: Q86VR2
  ENSP ID: ENSP00000309432
MAEAEGVPTTPGPASGSTFRGRRDVSGSWERDQQVEAAQRALVEVLGPYEPLLSRVQAALVWERPARSALWCLGLNAAFWFFALTSLRLVFLLAFGLMIIVCIDQWKNKIWPEIKVPRPDALDNESWGFVHPRLLSVPELCHHVAEVWVSGTIFIRNVLLFKKQNPGKFCLLSCGILTFLAVLGRYVPGLLLSYLMLVTVMMWPLAVYHRLWDRAYVRLKPALQRLDFSVRGYMMSKQRERQLRRRALHPERAMDNHSDSEEELAAFCPQLDDSTVARELAITDSEHSDAEVSCTDNGTFNLSRGQTPLTEGSEDLDGHSDPEESFARDLPDFPSINMDPAGLDDEDDTSIGMPSLMYRSPPGAEEPQAPPASRDEAALPELLLGALPVGSNLTSNLASLVSQGMIQLALSGASQPGPSGAPAQRATRGFLRSPSSDLDTDAEGDDFELLDQSELSQLDPASSRSH

SEQ ID NO: 29571 - protein, 129 aa, Homo sapiens
  Payload ID: 5774
  Gene Symbol: FAM134C
  Gene Name: family with sequence similarity 134, member C
  ENSP ID: ENSP00000465004
MAEAEGVPTTPGPASGSTFRGRRDVSGSWERDQQVEAAQRALVEVLGPYEPLLSRVQAALVWERPARSALWCLGLNAAFWFFALTSLRLVFLLAFGLMIIVCIDQWKNKIWPEIKVPRPDALDNESSAC

SEQ ID NO: 29572 - protein, 120 aa, Homo sapiens
  Payload ID: 5774
  Gene Symbol: FAM134C
  Gene Name: family with sequence similarity 134, member C
  ENSP ID: ENSP00000465016
MIIVCIDQWKNKIWPEIKVPRPDALDNESWGFVHPRLLSVPELCHHVAEVWVSGTIFIRNVLLFKKQNPGKFCLLSCGILTFLAVLGRYVPGLLLSYLMLVTVMMWPLAVYHRLWDRAYV

SEQ ID NO: 29573 - protein, 83 aa, Homo sapiens
  Payload ID: 5774
  Gene Symbol: FAM134C
  Gene Name: family with sequence similarity 134, member C
  ENSP ID: ENSP00000466145
MAEAEGVPTTPGPASGSTFRGRRDVSGSWERDQQVEAAQRALVEVLGPYEPLLSRVQAALVWERPARSALWCLGLNAAFCSAC

SEQ ID NO: 29574 - protein, 81 aa, Homo sapiens
  Payload ID: 5774
  Gene Symbol: FAM134C
  Gene Name: family with sequence similarity 134, member C
  ENSP ID: ENSP00000466482
MAEAEGVPTTPGPASGSTFRGRRDVSGSWERDQQVEAAQRALVEVLGPYEPLLSRVQAALVWERPARSALWCLGLNAAFWY

SEQ ID NO: 29575 - protein, 133 aa, Homo sapiens
  Payload ID: 5774
  Gene Symbol: FAM134C
  Gene Name: family with sequence similarity 134, member C
  ENSP ID: ENSP00000466925
MAEAEGVPTTPGPASGSTFRGRRDVSGSWERDQQVEAAQRALVEVLGPYEPLLSRVQAALVWERPARSALWCLGLNAAFWFFALTSLRLVFLLAFGLMIIVCIDQWKNKIWPEIKAGALCTLGCSACPSSATM

SEQ ID NO: 29576 - protein, 80 aa, Homo sapiens
  Payload ID: 5774
  Gene Symbol: FAM134C
  Gene Name: family with sequence similarity 134, member C
  ENSP ID: ENSP00000467157
MAEAEGVPTTPGPASGSTFRGRRDVSGSWERDQQVEAAQRALVEVLGPYEPLLSRVQAALVWERPARSALWCLGLNAAFW

SEQ ID NO: 29577 - protein, 109 aa, Homo sapiens
  Payload ID: 5774
  Gene Symbol: FAM134C
  Gene Name: family with sequence similarity 134, member C
  ENSP ID: ENSP00000467332
MQIARARLRMRLGASGSGSAPQFFALTSLRLVFLLAFGLMIIVCIDQWKNKIWPEIKVPRPDALDNESWGFVHPRLLSVPELCHHVAEVWVSGTIFIRNVLLFKKQNPG

SEQ ID NO: 29578 - protein, 369 aa, Homo sapiens
  Payload ID: 5774
  Gene Symbol: FAM134C
  Gene Name: family with sequence similarity 134, member C
  ENSP ID: ENSP00000467847
MIIVCIDQWKNKIWPEIKVPRPDALDNESWGFVHPRLLSVPELCHHVAEVWVSGTIFIRNVLLFKKQNPGKFCLLSCGILTFLAVLGRYVPGLLLSYLMLVTVMMWPLAVYHRLWDRAYVRLKPALQRLDFSVRGYMMSKQRERQLRRRALHPERAMDNHSDSEEELAAFCPQLDDSTVARELAITDSEHSDAEVSCTDNGTFNLSRGQTPLTEGSEDLDGHSDPEESFARDLPDFPSINMDPAGLDDEDDTSIGMPSLMYRSPPGAEEPQAPPASRDEAALPELLLGALPVGSNLTSNLASLVSQGMIQLALSGASQPGPSGAPAQRATRGFLRSPSSDLDTDAEGDDFELLDQSELSQLDPASSRSH

SEQ ID NO: 29579 - protein, 147 aa, Homo sapiens
  Payload ID: 5775
  Gene Symbol: FAM135A
  Gene Name: family with sequence similarity 135, member A
  ENSP ID: ENSP00000194672
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSSCIIGCTTPATNKLSSPCEDNLVK

SEQ ID NO: 29580 - protein, 1319 aa, Homo sapiens
  Payload ID: 5775
  Gene Symbol: FAM135A
  Gene Name: family with sequence similarity 135, member A
  Uniprot ID: Q9P2D6
  ENSP ID: ENSP00000354913
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 29581 - protein, 1515 aa, Homo sapiens
  Payload ID: 5775
  Gene Symbol: FAM135A
  Gene Name: family with sequence similarity 135, member A
  Uniprot ID: Q9P2D6
  ENSP ID: ENSP00000359510
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSENTKKLIKQNSKDSVVLVGYKCLKSTASNDLIKCFEGNPSHSQKEGLDPTICGYNFDPKTYMRQTSQKEASCLPTNTERTEQKSPDIENVQPDQFDPLNSGNLNLCANLSISGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 29582 - protein, 1302 aa, Homo sapiens
  Payload ID: 5775
  Gene Symbol: FAM135A
  Gene Name: family with sequence similarity 135, member A
  Uniprot ID: Q9P2D6
  ENSP ID: ENSP00000409201
MTEVQAMVEFSVELNKFYNVDLFQRGKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELAKANMQLLYERLLRRKQLRTQKDNHLEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 29583 - protein, 1515 aa, Homo sapiens; identical to SEQ ID NO: 29581
  Payload ID: 5775
  Gene Symbol: FAM135A
  Gene Name: family with sequence similarity 135, member A
  Uniprot ID: Q9P2D6
  ENSP ID: ENSP00000410768

SEQ ID NO: 29584 - protein, 31 aa, Homo sapiens
  Payload ID: 5775
  Gene Symbol: FAM135A
  Gene Name: family with sequence similarity 135, member A
  ENSP ID: ENSP00000421505
MTEVQAMVEFSVELNKFYNVDLFQRGFYQIR

SEQ ID NO: 29585 - protein, 505 aa, Homo sapiens
  Payload ID: 5775
  Gene Symbol: FAM135A
  Gene Name: family with sequence similarity 135, member A
  ENSP ID: ENSP00000422406
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSEN

SEQ ID NO: 29586 - protein, 1469 aa, Homo sapiens
  Payload ID: 5775
  Gene Symbol: FAM135A
  Gene Name: family with sequence similarity 135, member A
  Uniprot ID: Q9P2D6
  ENSP ID: ENSP00000423307
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSENTKKLIKQNSKDSVVLVGYKCLKSTASNDLIKCFEGNPSHSQKEGLDPTICGYNFDPKTYMRQTSQKEASCLPTNTERTEQKSPDIENVQPDQFDPLNSGNLNLCANLSISGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGNGIKLFQRVIGINELFPKFFL

SEQ ID NO: 29587 - protein, 1095 aa, Homo sapiens
  Payload ID: 5775
  Gene Symbol: FAM135A
  Gene Name: family with sequence similarity 135, member A
  ENSP ID: ENSP00000423785
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEGKLDISQDDSEITQMEHNLASRRSSDDCHDHQTTPSLGVRTIEIKPSNKDPFSGENITVKLGPWTELRQEEILVDNLLPNFESLESNDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 29588 - protein, 50 aa, Homo sapiens
  Payload ID: 5775
  Gene Symbol: FAM135A
  Gene Name: family with sequence similarity 135, member A
  ENSP ID: ENSP00000425101
MTEVQAMVEFSVELNKFYNVDLFQRGFYQIRASMKIPSRIPHRVEASLLH

SEQ ID NO: 29589 - protein, 153 aa, Homo sapiens
  Payload ID: 5776
  Gene Symbol: FAM135B
  Gene Name: family with sequence similarity 135, member B
  ENSP ID: ENSP00000160713
MSEIQGTVEFSVELHKFYNVDLFQRGYYQIRVTLKVSSRIPHRLSASIAGQTESSSLHSACVHDSTVHSRVFQILYRNEEVPINDAVVFRVHLLLGGERMEDALSEVDFQLKVDLHFTDSEQQLRDVAGAPMVSSRTLGLHFHPRNGLHHQVP

SEQ ID NO: 29590 - protein, 1141 aa, Homo sapiens
  Payload ID: 5776
  Gene Symbol: FAM135B
  Gene Name: family with sequence similarity 135, member B
  Uniprot ID: Q49AJ0
  ENSP ID: ENSP00000276737
MSEIQGTVEFSVELHKFYNVDLFQRGYYQIRVTLKVSSRIPHRLSASIAGQTESSSLHSACVHDSTVHSRVFQILYRNEEVPINDAVVFRVHLLLGGERMEDALSEVDFQLKVDLHFTDSEQQLRDVAGAPMVSSRTLGLHFHPRNGLHHQVPVMFDYFHLSVISVTVHAALVALQQPLISFTRPGRGSWLGKGGPDTGQEQSIISLENLVFGAGYCKPTSSEGSFYITSENCMQHAHKWHRDLCLLLLHAYRGLRLHFLVIMRDIPELPHTELEALAVEETLSQLCSELQMLNNPEKIAEQISKDLAWLTSHMMTLWTQFLDTVTLHSQVTTYLTQEHHTLRVRRFSEAFFYMEHQKLAVLTFQENLIQTHSQLSLDIRNSEYLTSMPPLPAECLDIDGDWNTLPVIFEDRYVDCPATGHNLSVYPNFDVPVTSPTIMNLKDKEDNCMVNSNLSFREDLVLSTIKPSQMDSDEEVIRCPEPGENVATQNHMDMCSESQVYISIGEFQNKAGVPEDECWTGQTSDAGTYPVADVDTSRRSPGPEDGQAPVLTYIDVKSSNKNPSRAEPLVAFNAQHESRSSRDKYGLDRTGLSKVVVGGSHQNAISSDKTTLHELSTLGKGIDQEGKMVLLSLKLTPSEPCDPLSSTLREPLDIRSSLKDSHTEEQEELSVLSGVIKRSSSIISDSGIESEPSSVAWSEARSRALELPSDREVLHPFVRRHALHRNSLEGGHTESNTSLPSGIQASLTSISSLPFEEDEREVALTKLTKSVSAPHISSPEEAAEDADTKQQDGGFAEPSDMHSKSQGSPGSCSQLCGDSGTDAGADHPLVEIVLDADNQQGPGYIDIPKGKGKQFDAQGHCLPDGRTENTPGVETKGLNLKIPRVIALENPRTRSLHRALEETPKGMPKDLNVGQQALSNSGISEVEGLSQHQVPELSCTSAADAINRNSTGQQSQSGSPCIMDDTAFNRGVNAFPEAKHKAGTVCPTVTHSVHSQVLKNQELKAGTSIMGSHLTSAETFTLDSLKAVEVVNLSVSCTATCLPFSSVPKETPARAGFSSKQTLFPITHQPLGSFGVVSTHSSTLDEEVSERMFRGRGRKFGRWNSPGCLCPWPGWEQCRPPAGKDFHRTGAPWRKTGLPNV

SEQ ID NO: 29591 - protein, 1406 aa, Homo sapiens
  Payload ID: 5776
  Gene Symbol: FAM135B
  Gene Name: family with sequence similarity 135, member B
  Uniprot ID: Q49AJ0
  ENSP ID: ENSP00000378710
MSEIQGTVEFSVELHKFYNVDLFQRGYYQIRVTLKVSSRIPHRLSASIAGQTESSSLHSACVHDSTVHSRVFQILYRNEEVPINDAVVFRVHLLLGGERMEDALSEVDFQLKVDLHFTDSEQQLRDVAGAPMVSSRTLGLHFHPRNGLHHQVPVMFDYFHLSVISVTVHAALVALQQPLISFTRPGRGSWLGKGGPDTGQEQSIISLENLVFGAGYCKPTSSEGSFYITSENCMQHAHKWHRDLCLLLLHAYRGLRLHFLVIMRDIPELPHTELEALAVEETLSQLCSELQMLNNPEKIAEQISKDLAWLTSHMMTLWTQFLDTVTLHSQVTTYLTQEHHTLRVRRFSEAFFYMEHQKLAVLTFQENLIQTHSQLSLDIRNSEYLTSMPPLPAECLDIDGDWNTLPVIFEDRYVDCPATGHNLSVYPNFDVPVTSPTIMNLKDKEDNCMVNSNLSFREDLVLSTIKPSQMDSDEEVIRCPEPGENVATQNHMDMCSESQVYISIGEFQNKAGVPEDECWTGQTSDAGTYPVADVDTSRRSPGPEDGQAPVLTYIDVKSSNKNPSRAEPLVAFNAQHESRSSRDKYGLDRTGLSKVVVGGSHQNAISSDKTTLHELSTLGKGIDQEGKMVLLSLKLTPSEPCDPLSSTLREPLDIRSSLKDSHTEEQEELSVLSGVIKRSSSIISDSGIESEPSSVAWSEARSRALELPSDREVLHPFVRRHALHRNSLEGGHTESNTSLPSGIQASLTSISSLPFEEDEREVALTKLTKSVSAPHISSPEEAAEDADTKQQDGGFAEPSDMHSKSQGSPGSCSQLCGDSGTDAGADHPLVEIVLDADNQQGPGYIDIPKGKGKQFDAQGHCLPDGRTENTPGVETKGLNLKIPRVIALENPRTRSLHRALEETPKGMPKDLNVGQQALSNSGISEVEGLSQHQVPELSCTSAADAINRNSTGQQSQSGSPCIMDDTAFNRGVNAFPEAKHKAGTVCPTVTHSVHSQVLKNQELKAGTSIMGSHLTSAETFTLDSLKAVEVVNLSVSCTATCLPFSSVPKETPARAGFSSKQTLFPITHQPLGSFGVVSTHSSTLDEEVSERMFSFYQAKEKFKKELKIEGFLYSDLTVLASDIPYFPPEEEEENLEDGIHLVVCVHGLDGNSADLRLVKTFIELGLPGGKLDFLMSEKNQMDTFADFDTMTDRLLDEIIQHIQLYNLSISRISFIGHSLGNIIIRSVLTRPRFRYYLNKLHTFLSLSGPHLGTLYNNSTLVSTGLWLMQKLKKSGSLLQLTFRDNADLRKCFLYQLSQKTGLQYFKNVVLVASPQDRYVPFHSARIEMCKTALKDRHTGPVYAEMINNLLGPLVEAKDCTLIRHNVFHALPNTANTLIGRAAHIAVLDSELFLEKFFLVAGLNYFK

SEQ ID NO: 29592 - protein, 68 aa, Homo sapiens
  Payload ID: 5776
  Gene Symbol: FAM135B
  Gene Name: family with sequence similarity 135, member B
  ENSP ID: ENSP00000428017
MSEIQGTVEFSVELHKFYNVDLFQRGYYQIRVTLKVSSRIPHRLSASIAGQTEVLNIHMSEQEPAQGK

SEQ ID NO: 29593 - protein, 43 aa, Homo sapiens
  Payload ID: 5776
  Gene Symbol: FAM135B
  Gene Name: family with sequence similarity 135, member B
  ENSP ID: ENSP00000429874
MSEIQGTVEFSVELHKFYNVDLFQRGMQSEFGISRAGDISKSS

SEQ ID NO: 29594 - protein, 451 aa, Homo sapiens
  Payload ID: 5776
  Gene Symbol: FAM135B
  Gene Name: family with sequence similarity 135, member B
  ENSP ID: ENSP00000430088
EPSSVAWSEARSRALELPSDREVLHPFVRRHALHRNSLEGGHTESNTSLPSGIQASLTSISSLPFEEDEREVALTKLTKSVSAPHISSPEEAAEDADTKQQDGGFAEPSDMHSKSQGSPGSCSQLCGDSGTDAGADHPLVEIVLDADNQQGPGYIDIPKGKGKQFDAQGHCLPDGRTENTPGVETKGLNLKIPRVIALENPRTRSLHRALEETPKGMPKDLNVGQQALSNSGISEVEGLSQHQVPELSCTSAADAINRNSTGQQSQSGSPCIMDDTAFNRGVNAFPEAKHKAGTVCPTVTHSVHSQVLKNQELKAGTSIMGSHLTSAETFTLDSLKAVEVVNLSVSCTATCLPFSSVPKETPARAGFSSKQTLFPITHQPLGSFGVVSTHSSTLDEEVSERMFRGRGRKFGRWNSPGCLCPWPGWEQCRPPAGKDFHRTGAPWRKTGLPNV

SEQ ID NO: 29595 - protein, 138 aa, Homo sapiens
  Payload ID: 5777
  Gene Symbol: FAM136A
  Gene Name: family with sequence similarity 136, member A
  Uniprot ID: Q96C01
  ENSP ID: ENSP00000037869
MAELQQLRVQEAVESMVKSLERENIRKMQGLMFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGK

SEQ ID NO: 29596 - protein, 163 aa, Homo sapiens
  Payload ID: 5777
  Gene Symbol: FAM136A
  Gene Name: family with sequence similarity 136, member A
  ENSP ID: ENSP00000390840
MVKSLERENIRKMQVAGLGPNQDPLLSGWVPGPSLSHHATPCTAAASPQTGCGRPWGRRGGLGQDFGSFGGSDEIRVPLPCARLFSAPSSPGQERPRRQGLMFRCSASCCEDSQASMKQVHQCIERCHVPLAQAQALVTSELEKFQDRLARCTMHCNDKAKDS

SEQ ID NO: 29597 - protein, 105 aa, Homo sapiens
  Payload ID: 5777
  Gene Symbol: FAM136A
  Gene Name: family with sequence similarity 136, member A
  ENSP ID: ENSP00000391468
MAELQQLRVQEAVESMVKSLERENIRKMQVSGPRPSRGAANVKDQKGEDFRPPRWPGHACFSCAQPRFTQRGFLHCSSLSPAMPLCVSVLLLSRRSHVPVQRQLL

SEQ ID NO: 29598 - protein, 245 aa, Homo sapiens
  Payload ID: 5777
  Gene Symbol: FAM136A
  Gene Name: family with sequence similarity 136, member A
  ENSP ID: ENSP00000397269
MAELQQLRVQEAVESMVKSLERENIRKMQVAGLGPNQDPLLSGWVPGPSLSHHATPCTAAASPQTGCGRPWGRRGGLGQDFGSFGGSDEIRVPLPCARLFSAPSSPGQERPRRQVGSPWWQALAPPPSPLTRPLPQGLMFRCSASCCEDSQASMKQVHQCIERCHVPLAQAQALVTSELEKFQDRLARCTMHCNDKAKDSIDAGSKELQVKQQLDSCVTKCVDDHMHLIPTMTKKMKEALLSIGK

SEQ ID NO: 29599 - protein, 482 aa, Homo sapiens
  Payload ID: 5778
  Gene Symbol: FAM149A
  Gene Name: family with sequence similarity 149, member A
  Uniprot ID: A5PLN7
  ENSP ID: ENSP00000227065
MLFEGKVNPQTQSLLAECGEWTRRSLHLRVLGRQLILPTDKGVQHFQGSTPASAVHRPPLSACGHSSNIRELCISGSQIVPAALSASALPGPDDTGVADLTARSSLEEEVYHVDGKIEEYFAFDRKEDDDECLEQKPAQPGRKWRKLGLPPVSPRDCVKDAVAAEVFDHVWTNMVELLEELIRKHWETTLTEGKKQRETLKVAGNRFPHVLVPHAHADGASGPPSGHAEAHGISLASRLNPPQIHHFSSSFYSDMNGVMTIQAKPLQRRPAYFADRTQNEKEDKASGGGAGALSSAPHRLGRASDTHGLSPSAKKTPVPWRLPSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRQSDTPRKSSLTQMEFAAHTWTGQSILTGSQYVPKSFQRTTLTFKRRFQVTS

SEQ ID NO: 29600 - protein, 773 aa, Homo sapiens
  Payload ID: 5778
  Gene Symbol: FAM149A
  Gene Name: family with sequence similarity 149, member A
  Uniprot ID: A5PLN7
  ENSP ID: ENSP00000348732
MKAAVLDLGSLLAKLFETSTAPPAGPSSRPSGGAAAAGSGGSRAGTPLGTAPTLLRALAPDSPSASRRSPAPLLSSPYSRGSAASRAAGAVGTLLSWPSSPRAGKAPPQPPTPSGGGCSPARLVVPARPPSGPGGVWAALPRNPLQPGPGERELGACVAPGAGPRTLFLTLPDIGEEGASDGDSGDGEARGLSEGRRRHGFTVRSKDSLPTHFTRNVQKAIDKYTCKSLSSFSSSGSHTPTGAHTSWSGSATQSSTTGSSTERGSVYSWRDDEFDEASSQSVQRLLWEVEEMLFEGKVNPQTQSLLAECGEWTRRSLHLRVLGRQLILPTDKGVQHFQGSTPASAVHRPPLSACGHSSNIRELCISGSQIVPAALSASALPGPDDTGVADLTARSSLEEEVYHVDGKIEEYFAFDRKEDDDECLEQKPAQPGRKWRKLGLPPVSPRDCVKDAVAAEVFDHVWTNMVELLEELIRKHWETTLTEGKKQRETLKVAGNRFPHVLVPHAHADGASGPPSGHAEAHGISLASRLNPPQIHHFSSSFYSDMNGVMTIQAKPLQRRPAYFADRTQNEKEDKASGGGAGALSSAPHRLGRASDTHGLSPSAKKTPVPWRLPSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRQSDTPRKSSLTQMEFAAHTWTGQSILTGSQYVPKSFQRTTLTFKRRFQVTS

SEQ ID NO: 29601 - protein, 402 aa, Homo sapiens
  Payload ID: 5778
  Gene Symbol: FAM149A
  Gene Name: family with sequence similarity 149, member A
  ENSP ID: ENSP00000374005
MLFEGKVNPQTQSLLAECGEWTRRSLHLRVLGRQLILPTDKGVQHFQGSTPASAVHRPPLSACGHSSNIRELCISGSQIVPAALSASALPGPDDTGVADLTARSSLEEEVYHVDGKIEEYFAFDRKEDDDECLEQKPAQPGRKWRKLGLPPVSPRDCVKDAVAAEVFDHVWTNMVELLEELIRKHWETTLTEGKKQRETLKVAGNRFPHVLVPHAHADGASGPPSGHAEAHGISLASRLNPPQIHHFSSSFYSDMNGVMTIQAKPLQRRPAYFADRTQNEKEDKASGGGAGALSSAPHRLGRASDTHGLSPSAKKTPVPWRLPSLASDSQRLKTPNIYSDEVLRGTTADWRGPHGFPTGSNVTEQVPPASHGDQGAEYSSSWMPPCFLQRKASTKPCVECHA

SEQ ID NO: 29602 - protein, 36 aa, Homo sapiens
  Payload ID: 5778
  Gene Symbol: FAM149A
  Gene Name: family with sequence similarity 149, member A
  ENSP ID: ENSP00000421136
MLFEGKVNPQTQSLLAECGEWTRRSLHLRVLGRQLI

SEQ ID NO: 29603 - protein, 61 aa, Homo sapiens
  Payload ID: 5778
  Gene Symbol: FAM149A
  Gene Name: family with sequence similarity 149, member A
  ENSP ID: ENSP00000421713
MLFEGKVNPQTQSLLAECGEWTRRSLHLRVLGRQLILPTDKGVQHFQGSTPASAVHRPPLS

SEQ ID NO: 29604 - protein, 76 aa, Homo sapiens
  Payload ID: 5778
  Gene Symbol: FAM149A
  Gene Name: family with sequence similarity 149, member A
  ENSP ID: ENSP00000422330
MLFEGKVNPQTQSLLAECGEWTRRSLHLRVLGRQLILPTDKGVQHFQGSTPASAVHRPPLSACGHSSNIRELCISG

SEQ ID NO: 29605 - protein, 53 aa, Homo sapiens
  Payload ID: 5778
  Gene Symbol: FAM149A
  Gene Name: family with sequence similarity 149, member A
  ENSP ID: ENSP00000422584
  MOD_RES (1)..(1): Any amino acid
XLTQMEFAAHTWTGQSILTEDNFDFQEEIPSDILKPPHQNHWSTCGLGTLLIT

SEQ ID NO: 29606 - protein, 159 aa, Homo sapiens
  Payload ID: 5778
  Gene Symbol: FAM149A
  Gene Name: family with sequence similarity 149, member A
  ENSP ID: ENSP00000422722
  MOD_RES (1)..(1): Any amino acid
XSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRSDTPRKSSLTQMEFAAHTWTGQSILTGSQYVPKSFQRTTLTFKRRFQVTS

SEQ ID NO: 29607 - protein, 147 aa, Homo sapiens
  Payload ID: 5778
  Gene Symbol: FAM149A
  Gene Name: family with sequence similarity 149, member A
  ENSP ID: ENSP00000423143
  MOD_RES (1)..(1): Any amino acid
XSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRQSDTPRKSSLTQMEFAAHTWTGQSILTGGNSKCLGPVA

SEQ ID NO: 29608 - protein, 482 aa, Homo sapiens; identical to SEQ ID NO: 29599
  Payload ID: 5778
  Gene Symbol: FAM149A
  Gene Name: family with sequence similarity 149, member A
  Uniprot ID: A5PLN7
  ENSP ID: ENSP00000424380

SEQ ID NO: 29609 - protein, 482 aa, Homo sapiens; identical to SEQ ID NO: 29599
  Payload ID: 5778
  Gene Symbol: FAM149A
  Gene Name: family with sequence similarity 149, member A
  Uniprot ID: A5PLN7
  ENSP ID: ENSP00000426835

SEQ ID NO: 29610 - protein, 482 aa, Homo sapiens; identical to SEQ ID NO: 29599
  Payload ID: 5778
  Gene Symbol: FAM149A
  Gene Name: family with sequence similarity 149, member A
  Uniprot ID: A5PLN7
  ENSP ID: ENSP00000427155

SEQ ID NO: 29611 - protein, 582 aa, Homo sapiens
  Payload ID: 5779
  Gene Symbol: FAM149B1
  Gene Name: family with sequence similarity 149, member B1
  Uniprot ID: Q96BN6
  ENSP ID: ENSP00000242505
MISRYTRKAVPQSLELKGITKHALNHHPPPEKLEEISPTSDSHEKDTSSQSKSDITRESSFTSADTGNSLSAFPSYTGAGISTEGSSDFSWGYGELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMKPHGDSSRAQSAVVDEPNYQQPQERLLLPDFFPRPNTTQSFLLDTQYRRSCAVEYPHQARPGRGSAGPQLHGSTKSQSGGRPVSRTRQGP

SEQ ID NO: 29612 - protein, 469 aa, Homo sapiens
  Payload ID: 5779
  Gene Symbol: FAM149B1
  Gene Name: family with sequence similarity 149, member B1
  ENSP ID: ENSP00000362046
  MOD_RES (1)..(1): Any amino acid
XFTSADTGNSLSAFPSYTGAGISTEGSSDFSWGYGELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMKPHGDSSRAQSAVVDEPNYQQPQERLLLPDFFPRPNTTQSFLVE

SEQ ID NO: 29613 - protein, 335 aa, Homo sapiens
  Payload ID: 5779
  Gene Symbol: FAM149B1
  Gene Name: family with sequence similarity 149, member B1
  ENSP ID: ENSP00000402293
SSFCSMERDEEDSIIVSEGIIEEYLAFDHIDIEEGFHGKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARVPVAPDSLSSPSPTPLSRNNLLPPIGTAEVEHVSTVGPQRQMLDTQYRRSCAVEYPHQARPGRGSAGPQLHGSTKSQSGGRPVSRTRQGP

SEQ ID NO: 29614 - protein, 209 aa, Homo sapiens
  Payload ID: 5779
  Gene Symbol: FAM149B1
  Gene Name: family with sequence similarity 149, member B1
  ENSP ID: ENSP00000476913
GKKSEAATEKQKLGYPPIAPFYCMKEDVLAYVFDSVWCKVVSCMEQLTRSHWEGFASDDESNVAVTRPDSESSCVLSELHPLVLPRVPQSKVLYITSNPMSLCQASRHQPNVNDLLVHGMPLQPRNLSLMDKLLDLDDKLLMRPGSSTILSTRNWPNRAVEFSTSSLSYTVQSTRRRNPPPRTLHPISTSHSCAETPRSVEEILRGARV

SEQ ID NO: 29615 - protein, 129 aa, Homo sapiens
  Payload ID: 5780
  Gene Symbol: FAM150A
  Gene Name: family with sequence similarity 150, member A
  Uniprot ID: Q6UXT8
  ENSP ID: ENSP00000351345
MRPLKPGAPLPALFLLALALSPHGAHGRPRGRRGARVTDKEPKPLLFLPAAGAGRTPSGSRSAEIFPRDSNLKDKFIKHFTGPVTFSPECSKHFHRLYYNTRECSTPAYYKRCARLLTRLAVSPLCSQT

SEQ ID NO: 29616 - protein, 111 aa, Homo sapiens
  Payload ID: 5780
  Gene Symbol: FAM150A
  Gene Name: family with sequence similarity 150, member A
  Uniprot ID: Q6UXT8
  ENSP ID: ENSP00000430953
MRPLKPGAPLPALFLLALALSPHGAHGRPRGRRGARVTDKEPKPLLFLPAAGAGRTPSGSRSAEIFPRDSNLKDKFIKHFTGPVTFSPECSKHFHRLYYNTRECSTPAYIS

SEQ ID NO: 29617 - protein, 59 aa, Homo sapiens
  Payload ID: 5781
  Gene Symbol: FAM150B
  Gene Name: family with sequence similarity 150, member B
  ENSP ID: ENSP00000339565
MKDKFLKHLTGPLYFSPKCSKHFHRLYHNTRDCTIPAYYKRCARLLTRLAVSPVCMEDK

SEQ ID NO: 29618 - protein, 152 aa, Homo sapiens
  Payload ID: 5781
  Gene Symbol: FAM150B
  Gene Name: family with sequence similarity 150, member B
  Uniprot ID: Q6UX46
  ENSP ID: ENSP00000384604
MRGPGHPLLLGLLLVLGAAGRGRGGAEPREPADGQALLRLVVELVQELRKHHSAEHKGLQLLGRDCALGRAEAAGLGPSPEQRVEIVPRDLRMKDKFLKHLTGPLYFSPKCSKHFHRLYHNTRDCTIPAYYKRCARLLTRLAVSPVCMEDKQ

SEQ ID NO: 29619 - protein, 102 aa, Homo sapiens
  Payload ID: 5781
  Gene Symbol: FAM150B
  Gene Name: family with sequence similarity 150, member B
  ENSP ID: ENSP00000385214
  MOD_RES (1)..(1): Any amino acid
XHHSAEHKGLQLLGRDCALGRAEAAGLGPSPEQRVEIVPRDLRMKDKFLKHLTGPLYFSPKCSKHFHRLYHNTRDCTIPAYYKRCARLLTRLAVSPVCMEDK

SEQ ID NO: 29620 - protein, 60 aa, Homo sapiens
  Payload ID: 5781
  Gene Symbol: FAM150B
  Gene Name: family with sequence similarity 150, member B
  ENSP ID: ENSP00000385537
MKDKFLKHLTGPLYFSPKCSKHFHRLYHNTRDCTIPAYYKRCARLLTRLAVSPVCMEDKQ

SEQ ID NO: 29621 - protein, 59 aa, Homo sapiens; identical to SEQ ID NO: 29617
  Payload ID: 5781
  Gene Symbol: FAM150B
  Gene Name: family with sequence similarity 150, member B
  ENSP ID: ENSP00000385672

SEQ ID NO: 29622 - protein, 151 aa, Homo sapiens
  Payload ID: 5781
  Gene Symbol: FAM150B
  Gene Name: family with sequence similarity 150, member B
  ENSP ID: ENSP00000389939
MRGPGHPLLLGLLLVLGAAGRGRGGAEPREPADGQALLRLVVELVQELRKHHSAEHKGLQLLGRDCALGRAEAAGLGPSPEQRVEIVPRDLRMKDKFLKHLTGPLYFSPKCSKHFHRLYHNTRDCTIPAYYKRCARLLTRLAVSPVCMEDK

SEQ ID NO: 29623 - protein, 91 aa, Homo sapiens
  Payload ID: 5781
  Gene Symbol: FAM150B
  Gene Name: family with sequence similarity 150, member B
  Uniprot ID: Q6UX46
  ENSP ID: ENSP00000478180
MRGPGHPLLLGLLLVLGPSPEQRVEIVPRDLRMKDKFLKHLTGPLYFSPKCSKHFHRLYHNTRDCTIPAYYKRCARLLTRLAVSPVCMEDK

SEQ ID NO: 29624 - protein, 585 aa, Homo sapiens
  Payload ID: 5782
  Gene Symbol: FAM151A
  Gene Name: family with sequence similarity 151, member A
  Uniprot ID: Q8WW52
  ENSP ID: ENSP00000306888
MVCREQLSKNQVKWVFAGITCVSVVVIAAIVLAITLRRPGCELEACSPDADMLDYLLSLGQISRRDALEVTWYHAANSKKAMTAALNSNITVLEADVNVEGLGTANETGVPIMAHPPTIYSDNTLEQWLDAVLGSSQKGIKLDFKNIKAVGPSLDLLRQLTEEGKVRRPIWINADILKGPNMLISTEVNATQFLALVQEKYPKATLSPGWTTFYMSTSPNRTYTQAMVEKMHELVGGVPQRVTFPVRSSMVRAAWPHFSWLLSQSERYSLTLWQAASDPMSVEDLLYVRDNTAVHQVYYDIFEPLLSQFKQLALNATRKPMYYTGGSLIPLLQLPGDDGLNVEWLVPDVQGSGKTATMTLPDTEGMILLNTGLEGTVAENPVPIVHTPSGNILTLESCLQQLATHPGHWGIHLQIAEPAALRPSLALLARLSSLGLLHWPVWVGAKISHGSFSVPGHVAGRELLTAVAEVFPHVTVAPGWPEEVLGSGYREQLLTDMLELCQGLWQPVSFQMQAMLLGHSTAGAIGRLLASSPRATVTVEHNPAGGDYASVRTALLAARAVDRTRVYYRLPQGYHKDLLAHVGRN

SEQ ID NO: 29625 - protein, 398 aa, Homo sapiens
  Payload ID: 5782
  Gene Symbol: FAM151A
  Gene Name: family with sequence similarity 151, member A
  Uniprot ID: Q8WW52
  ENSP ID: ENSP00000360353
MVCREQLSKNQVKWVFAGITCVSVVVIAAIVLAITLRRPGCELEACSPDADMLDYLLSLGQISRRDALEVTWYHAANSKKAMTAALNSNITVLEADVNVEGLGTANETGVPIMAHPPTIYSDNTLEQWLDAVLGSSQKGIKLDFKNIKAVGPSLDLLRQLTEEGKVRRPIWINADILKGPNMLISTEVNATQFLALVQEKYPKATLSPGWTTFYMSTSPNRTYTQAMVEKMHELVGGVPQRVTFPVRSSMVRAAWPHFSWLLSQSERYSLTLWQAASDPMSVEDLLYVRDNTAVHQVYYDIFEPLLLTDMLELCQGLWQPVSFQMQAMLLGHSTAGAIGRLLASSPRATVTVEHNPAGGDYASVRTALLAARAVDRTRVYYRLPQGYHKDLLAHVGRN

SEQ ID NO: 29626 - protein, 276 aa, Homo sapiens
  Payload ID: 5783
  Gene Symbol: FAM151B
  Gene Name: family with sequence similarity 151, member B
  Uniprot ID: Q6UXP7
  ENSP ID: ENSP00000282226
MAASAGGPGSWSENILEYFLRNSQITAEDGAEITWYHAANHKAQTNEALKSTAHMIEADVLLPSDGSEHSQPIMAHPPETNSDNTLQEWLTEVMKSNKGIKLDFKSLAVVEPSMMLLENVKRHLKRPVWINADILPGPNGNSKVIDAKPFLDTVISFFPDVTFSLGWTTGWHPEKVNEGYSWTMVKEMEYICNELSQPVTFPVRAALVRQSCSQLLWLLKKSNRYSLTIWTGKNDNYSVEDLLYIRDHFDKKQVFYDILEPQNHEFKQAIGIKVNL

SEQ ID NO: 29627 - protein, 67 aa, Homo sapiens
  Payload ID: 5783
  Gene Symbol: FAM151B
  Gene Name: family with sequence similarity 151, member B
  ENSP ID: ENSP00000427035
MAASAGGPGSWSENILEYFLRNSQITAEDGAEITWYHAANHKAQTNEALKKTRFHRVGQTGLELLTS

SEQ ID NO: 29628 - protein, 310 aa, Homo sapiens
  Payload ID: 5784
  Gene Symbol: FAM153A
  Gene Name: family with sequence similarity 153, member A
  Uniprot ID: Q9UHL3
  ENSP ID: ENSP00000353887
MVDKDTERDIEMKRQLRRLRELHLYSTWKKYQEAMKTSLGVPQCERDEGSLGKPLCPPEILSETLPGSVKKRVCFPSEDHLEEFIAEHLPEASNQSLLTVAHADAGTQTNGDLEDLEEHGPGQTVSEEATEVHTMEGDPDTLAEFLIRDVLQELSSYNGEEEDPEEVKTSLGVPQRGDLEDLEEHVPGQTVSEEATGVHMMQVDPATLAKSDLEDLEEHVPEQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 29629 - protein, 114 aa, Homo sapiens
  Payload ID: 5784
  Gene Symbol: FAM153A
  Gene Name: family with sequence similarity 153, member A
  ENSP ID: ENSP00000377153
MVDKDTERDIEMKRQLRRLRELHLYSTWKKYQEAMKTSLGVPQRGDLEDLEEHVPGQTVSEEATGVHMMQVDPATLAKQLEDSTITGSHQQMSASPSSAPAEEATEKTKVEEEV

SEQ ID NO: 29630 - protein, 310 aa, Homo sapiens; identical to SEQ ID NO: 29628
  Payload ID: 5784
  Gene Symbol: FAM153A
  Gene Name: family with sequence similarity 153, member A
  Uniprot ID: Q9UHL3
  ENSP ID: ENSP00000411506

SEQ ID NO: 29631 - protein, 129 aa, Homo sapiens [sequence omitted]

SEQ ID NO: 29632 - protein, 310 aa, Homo sapiens; identical to SEQ ID NO: 29628
  Payload ID: 5784
  Gene Symbol: FAM153A
  Gene Name: family with sequence similarity 153, member A
  Uniprot ID: Q9UHL3
  ENSP ID: ENSP00000422174

SEQ ID NO: 29633 - protein, 119 aa, Homo sapiens
  Payload ID: 5784
  Gene Symbol: FAM153A
  Gene Name: family with sequence similarity 153, member A
  ENSP ID: ENSP00000423766
MGCVYSCCLEDYDEDLVQEASSEDVLGVHMVDKDTERDIEMKRQLRRLRELHLYSTWKKYQEAMKTSLGVPQCERDEGSLGKPLCPPEILSETLPGSVKKRVCFPSEDHLEEFIAEHLP

SEQ ID NO: 29634 - protein, 41 aa, Homo sapiens
  Payload ID: 5784
  Gene Symbol: FAM153A
  Gene Name: family with sequence similarity 153, member A
  ENSP ID: ENSP00000424904
MGCVYSCCLEVCCGEDEIVYPRMPGESTVCHREREKPITYH

SEQ ID NO: 29635 - protein, 24 aa, Homo sapiens
  Payload ID: 5784
  Gene Symbol: FAM153A
  Gene Name: family with sequence similarity 153, member A
  ENSP ID: ENSP00000425021
MVDKDTERDSTYSGITPMLRKNSS

SEQ ID NO: 29636 - protein, 35 aa, Homo sapiens
  Payload ID: 5784
  Gene Symbol: FAM153A
  Gene Name: family with sequence similarity 153, member A
  ENSP ID: ENSP00000425931
MGCVYSCCLEDYDEDLVQEASSEDVLGVHMCFVFL

SEQ ID NO: 29637 - protein, 144 aa, Homo sapiens
  Payload ID: 5784
  Gene Symbol: FAM153A
  Gene Name: family with sequence similarity 153, member A
  ENSP ID: ENSP00000426689
MVDKDTERDIEMKRQLRRLRELHLYSTWKKYQEAMKTSLGVPQRGDLEDLEEHVPGQTVSEEATGVHMMQVDPATLAKKLEDSTITGSHQQMSASPSSAPAEEATEKTKVEEEVKTRKPKKKTRKPSKKSRWNVLKCWDIFNIF

SEQ ID NO: 29638 - protein, 387 aa, Homo sapiens
  Payload ID: 5784
  Gene Symbol: FAM153A
  Gene Name: family with sequence similarity 153, member A
  ENSP ID: ENSP00000481950
MGCVYSCCLEVCCGEDEIVYPRMPGESTVCHREREKPITYHWYHWHPGHIYPRIASMEDYDEDLVQEASSEDVLGVHMVDKDTERDIEMKRQLRRLRELHLYSTWKKYQEAMKTSLGVPQCERDEGSLGKPLCPPEILSETLPGSVKKRVCFPSEDHLEEFIAEHLPEASNQSLLTVAHADAGTQTNGDLEDLEEHGPGQTVSEEATEVHTMEGDPDTLAEFLIRDVLQELSSYNGEEEDPEEVKTSLGVPQRGDLEDLEEHVPGQTVSEEATGVHMMQVDPATLAKSDLEDLEEHVPEQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 29639 - protein, 387 aa, Homo sapiens
  Payload ID: 5785
  Gene Symbol: FAM153B
  Gene Name: family with sequence similarity 153, member B
  Uniprot ID: P0C7A2
  ENSP ID: ENSP00000253490
MGCAYSCCLEVCCGEDEIVYPRMPGESTVCHREREKPITYHWYHWHPGHIYPRVASMEDYDEDLVQEASSEDVLGVHMVDKDTERDIEMKRQLRRLRELHLYSTWKKYQEAMKTSLGVPQCERDEGSLGKPLCPPEILSETLPGSVKKRVCFPSEDHLEEFIAEHLPEASNQSLLTVAHADTGIQTNGDLEDLEEHGPGQTVSEEATEVHMMEGDPDTLAELLIRDVLQELSSYNGEEEDPEEVKTSLGVPQRGDLEDLEEHVPGQTVSEEATGVHMMQVDPATPAKSDLEDLEEHVPGQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 29640 - protein, 310 aa, Homo sapiens
  Payload ID: 5785
  Gene Symbol: FAM153B
  Gene Name: family with sequence similarity 153, member B
  ENSP ID: ENSP00000424849
MVDKDTERDIEMKRQLRRLRELHLYSTWKKYQEAMKTSLGVPQCERDEGSLGKPLCPPEILSETLPGSVKKRVCFPSEDHLEEFIAEHLPEASNQSLLTVAHADTGIQTNGDLEDLEEHGPGQTVSEEATEVHMMEGDPDTLAELLIRDVLQELSSYNGEEEDPEEVKTSLGVPQRGDLEDLEEHVPGQTVSEEATGVHMMQVDPATPAKSDLEDLEEHVPGQTVSEEATGVHMMQVDPATLAKQLEDSTITGSHQQMSASPSSAPAEEATEKTKVEEEVKTRKPKKKTRKPSKKSRWNVLKCWDIFNIF

SEQ ID NO: 29641 - protein, 310 aa, Homo sapiens; identical to SEQ ID NO: 29640
  Payload ID: 5785
  Gene Symbol: FAM153B
  Gene Name: family with sequence similarity 153, member B
  ENSP ID: ENSP00000427684

SEQ ID NO: 29642 - protein, 133 aa, Homo sapiens
  Payload ID: 5785
  Gene Symbol: FAM153B
  Gene Name: family with sequence similarity 153, member B
  ENSP ID: ENSP00000453011
MKRQLRRLRELHLYSTWKKYQEAMKTSLGVPQCERDEGSLGKPLCPPEILSETLPGSVKKRVCFPSEDHLEEFIAEHLPEASNQSLLTVAHADTGIQTNGDLEDLEEHGPGQTVSEEATEVHMMEGDPDTLAE

SEQ ID NO: 29643 - protein, 310 aa, Homo sapiens; identical to SEQ ID NO: 29640
  Payload ID: 5785
  Gene Symbol: FAM153B
  Gene Name: family with sequence similarity 153, member B
  ENSP ID: ENSP00000453424

SEQ ID NO: 29644 - protein, 144 aa, Homo sapiens
  Payload ID: 5785
  Gene Symbol: FAM153B
  Gene Name: family with sequence similarity 153, member B
  ENSP ID: ENSP00000453712
MVDKDTERDIEMKRQLRRLRELHLYSTWKKYQEAMKTSLGVPQRGDLEDLEEHVPGQTVSEEATGVHMMQVDPATPAKKLEDSTITGSHQQMSASPSSAPAEEATEKTKVEEEVKTRKPKKKTRKPSKKSRWNVLKCWDIFNIF

SEQ ID NO: 29645 - protein, 144 aa, Homo sapiens; identical to SEQ ID NO: 29644
  Payload ID: 5785
  Gene Symbol: FAM153B
  Gene Name: family with sequence similarity 153, member B
  ENSP ID: ENSP00000481297

SEQ ID NO: 29646 - protein, 114 aa, Homo sapiens
  Payload ID: 5786
  Gene Symbol: FAM153C
  Gene Name: family with sequence similarity 153, member C
  Uniprot ID: Q494X1
  ENSP ID: ENSP00000381177
MVDKDTERDIEMKRQLRRLRELHLYSTWKKYQEAMKTSLGVPQRGDLEDLEEHLPGQTVSEEATGVHMMQVDPATPAKKLEDSTITGSHQQMSASPSSAPAEEATEKTKVEEEV

SEQ ID NO: 29647 - protein, 176 aa, Homo sapiens
  Payload ID: 5786
  Gene Symbol: FAM153C
  Gene Name: family with sequence similarity 153, member C
  ENSP ID: ENSP00000422293
MGCAYSCCLEVCCGKDEIVYPRMPGESTVCHREREKPITYHWYHWHPGHIYPRVASMEDYDEDLVQEASSEDVLGVHMVDKDTERDIEMKRQLRRLRELHLYSTWKKYQEAMKTSLGVPQRGDLEDLEEHLPGQTVSEEATGVHMMQVDPATPAKKLEDSTITGSHQQMSASPSSA

SEQ ID NO: 29648 - protein, 39 aa, Homo sapiens
  Payload ID: 5786
  Gene Symbol: FAM153C
  Gene Name: family with sequence similarity 153, member C
  ENSP ID: ENSP00000423403
MVDKDTERDIEMKRQLRRLRELHLYSTWKKYQEAMKTSL

SEQ ID NO: 29649 - protein, 144 aa, Homo sapiens
  Payload ID: 5786
  Gene Symbol: FAM153C
  Gene Name: family with sequence similarity 153, member C
  Uniprot ID: Q494X1
  ENSP ID: ENSP00000424623
MVDKDTERDIEMKRQLRRLRELHLYSTWKKYQEAMKTSLGVPQRGDLEDLEEHLPGQTVSEEATGVHMMQVDPATPAKKLEDSTITGSHQQMSASPSSAPAEEATEKTKVEEEVKTRKPKKKTRKPSKKSRWNVLKCWDIFNIF

SEQ ID NO: 29650 - protein, 173 aa, Homo sapiens
  Payload ID: 5786
  Gene Symbol: FAM153C
  Gene Name: family with sequence similarity 153, member C
  ENSP ID: ENSP00000426621
MGCAYSCCLEDYDEDLVQEASSEDVLGVHMVDKDTERDIEMKRQLRRLRELHLYSTWKKYQEAMKTSLGVPQRGDLEDLEEHLPGQTVSEEATGVHMMQVDPATPAKKLEDSTITGSHQQMSASPSSAPAEEATEKTKVEEEVKTRKPKKKTRKPSKKSRWNVLKCWDIFNIF

SEQ ID NO: 29651 - protein, 144 aa, Homo sapiens; identical to SEQ ID NO: 29649
  Payload ID: 5786
  Gene Symbol: FAM153C
  Gene Name: family with sequence similarity 153, member C
  Uniprot ID: Q494X1
  ENSP ID: ENSP00000481919

SEQ ID NO: 29652 - protein, 458 aa, Homo sapiens
  Payload ID: 5787
  Gene Symbol: FAM155A
  Gene Name: family with sequence similarity 155, member A
  Uniprot ID: B1AL88
  ENSP ID: ENSP00000365080
MTRGAWMCRQYDDGLKIWLAAPRENEKPFIDSERAQKWRLSLASLLFFTVLLSDHLWFCAEAKLTRARDKEHQQQQRQQQQQQQQQRQRQQQQQQRRQQEPSWPALLASMGESSPAAQAHRLLSASSSPTLPPSPGDGGGGGGKGNRGKDDRGKALFLGNSAKPVWRLETCYPQGASSGQCFTVENADAVCARNWSRGAAGGDGQEVRSKHPTPLWNLSDFYLSFCNSYTLWELFSGLSSPNTLNCSLDVVLKEGGEMTTCRQCVEAYQDYDHHAQEKYEEFESVLHKYLQSEEYSVKSCPEDCKIVYKAWLCSQYFEVTQFNCRKTIPCKQYCLEVQTRCPFILPDNDEVIYGGLSSFICTGLYETFLTNDEPECCDVRREEKSNNPSKGTVEKSGSCHRTSLTVSSATRLCNSRLKLCVLVLILLHTVLTASAAQNTAGLSFGGINTLEENSTNEE

SEQ ID NO: 29653 - protein, 472 aa, Homo sapiens
  Payload ID: 5788
  Gene Symbol: FAM155B
  Gene Name: family with sequence similarity 155, member B
  Uniprot ID: O75949
  ENSP ID: ENSP00000252338
MFRGAWMWPGKDAAALTICCCCCCWAPRPSDKPCADSERAQRWRLSLASLLFFTVLLADHLWLCAGARPRARELSSAMRPPWGAGRERQPVPPRAVLPLPPPPPGEPSAPPGTCGPRYSNLTKAAPAAGSRPVCGGVPEPTGLDAACTKLQSLQRLFEPTTPAPPLRPPDSLSRAPAEFPSAKKNLLKGHFRNFTLSFCDTYTVWDLLLGMDRPDSLDCSLDTLMGDLLAVVASPGSGAWEACSNCIEAYQRLDRHAQEKYDEFDLVLHKYLQAEEYSIRSCTKGCKAVYKAWLCSEYFSVTQQECQRWVPCKQYCLEVQTRCPFILPDNEEMVYGGLPGFICTGLLDTSPKRLETKCCDVQWVSCEAKKKKFKESEAPKTHQQQFHHSYFHHYHQQYHHYHPHHDPPGRVSNKPALLPVSGGSRLSPSRIRLCVLVLMLLHTVVSFSSNQGGGGLGLETLPALEEGLTREE

SEQ ID NO: 29654 - protein, 213 aa, Homo sapiens
  Payload ID: 5789
  Gene Symbol: FAM156A
  Gene Name: family with sequence similarity 156, member A
  Uniprot ID: Q8NDB6
  ENSP ID: ENSP00000471676
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECRYCQSHRPNLSGIPGESNRAPHPSSWETLVQGLSGLTLSLGTNQPGPLPEAALQPQETEEKRQRERQQESKIMFQRLLKQWLEEN

SEQ ID NO: 29655 - protein, 38 aa, Homo sapiens
  Payload ID: 5789
  Gene Symbol: FAM156A
  Gene Name: family with sequence similarity 156, member A
  ENSP ID: ENSP00000477905
MDPLQKRNPASPSKSSPMTAAETSQEGPAPSQPSYSEQ

SEQ ID NO: 29656 - protein, 213 aa, Homo sapiens; identical to SEQ ID NO: 29654
  Payload ID: 5789
  Gene Symbol: FAM156A
  Gene Name: family with sequence similarity 156, member A
  Uniprot ID: Q8NDB6
  ENSP ID: ENSP00000479184

SEQ ID NO: 29657 - protein, 111 aa, Homo sapiens
  Payload ID: 5789
  Gene Symbol: FAM156A
  Gene Name: family with sequence similarity 156, member A
  ENSP ID: ENSP00000479338
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREA

SEQ ID NO: 29658 - protein, 184 aa, Homo sapiens
  Payload ID: 5789
  Gene Symbol: FAM156A
  Gene Name: family with sequence similarity 156, member A
  ENSP ID: ENSP00000479348
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECRYCQSHRPNLSGIPGESNRAPHPSSWETLVQGLSGLTLSLGTNQPGPLPEAALQPQ

SEQ ID NO: 29659 - protein, 4 aa, Homo sapiens
  Payload ID: 5789
  Gene Symbol: FAM156A
  Gene Name: family with sequence similarity 156, member A
  ENSP ID: ENSP00000479822
MDPL

SEQ ID NO: 29660 - protein, 213 aa, Homo sapiens; identical to SEQ ID NO: 29654
  Payload ID: 5789
  Gene Symbol: FAM156A
  Gene Name: family with sequence similarity 156, member A
  Uniprot ID: Q8NDB6
  ENSP ID: ENSP00000480373

SEQ ID NO: 29661 - protein, 213 aa, Homo sapiens; identical to SEQ ID NO: 29654
  Payload ID: 5789
  Gene Symbol: FAM156A
  Gene Name: family with sequence similarity 156, member A
  Uniprot ID: Q8NDB6
  ENSP ID: ENSP00000480518

SEQ ID NO: 29662 - protein, 213 aa, Homo sapiens; identical to SEQ ID NO: 29654
  Payload ID: 5789
  Gene Symbol: FAM156A
  Gene Name: family with sequence similarity 156, member A
  Uniprot ID: Q8NDB6
  ENSP ID: ENSP00000481435

SEQ ID NO: 29663 - protein, 131 aa, Homo sapiens
  Payload ID: 5789
  Gene Symbol: FAM156A
  Gene Name: family with sequence similarity 156, member A
  ENSP ID: ENSP00000481568
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECRYC

SEQ ID NO: 29664 - protein, 213 aa, Homo sapiens; identical to SEQ ID NO: 29654
  Payload ID: 5789
  Gene Symbol: FAM156A
  Gene Name: family with sequence similarity 156, member A
  Uniprot ID: Q8NDB6
  ENSP ID: ENSP00000482142

SEQ ID NO: 29665 - protein, 82 aa, Homo sapiens
  Payload ID: 5789
  Gene Symbol: FAM156A
  Gene Name: family with sequence similarity 156, member A
  ENSP ID: ENSP00000482562
MDPLQKRNPASPSKSSPMTAAETSQEGPAPSQPSYSEQPMMGLSNLSPGPGPSQAVPLPEGLLRQRYREEKTLEERRWERLE

SEQ ID NO: 29666 - protein, 56 aa, Homo sapiens
  Payload ID: 5789
  Gene Symbol: FAM156A
  Gene Name: family with sequence similarity 156, member A
  ENSP ID: ENSP00000482980
MDPLQKRNPASPSKSSPMTAAETSQEGPAPSQPSYSEQPMMGLSNLSPGPGPSQAV

SEQ ID NO: 29667 - protein, 213 aa, Homo sapiens; identical to SEQ ID NO: 29654
  Payload ID: 5789
  Gene Symbol: FAM156A
  Gene Name: family with sequence similarity 156, member A
  Uniprot ID: Q8NDB6
  ENSP ID: ENSP00000484167

SEQ ID NO: 29668 - protein, 3 aa, Homo sapiens
  Payload ID: 5789
  Gene Symbol: FAM156A
  Gene Name: family with sequence similarity 156, member A
  ENSP ID: ENSP00000484486
MDP

SEQ ID NO: 29669 - protein, 126 aa, Homo sapiens
  Payload ID: 5789
  Gene Symbol: FAM156A
  Gene Name: family with sequence similarity 156, member A
  ENSP ID: ENSP00000484757
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRC

SEQ ID NO: 29670 - protein, 35 aa, Homo sapiens
  Payload ID: 5789
  Gene Symbol: FAM156A
  Gene Name: family with sequence similarity 156, member A
  ENSP ID: ENSP00000484967
MDPLQKRNPASPSKSSPMTAAETSQEGPAPSQPSY

SEQ ID NO: 29671 - protein, 213 aa, Homo sapiens; identical to SEQ ID NO: 29654
  Payload ID: 5789
  Gene Symbol: FAM156A
  Gene Name: family with sequence similarity 156, member A
  Uniprot ID: Q8NDB6
  ENSP ID: ENSP00000485247

SEQ ID NO: 29672 - protein, 213 aa, Homo sapiens; identical to SEQ ID NO: 29654
  Payload ID: 5790
  Gene Symbol: FAM156B
  Gene Name: family with sequence similarity 156, member B
  Uniprot ID: Q8NDB6
  ENSP ID: ENSP00000422411

SEQ ID NO: 29673 - protein, 213 aa, Homo sapiens; identical to SEQ ID NO: 29654
  Payload ID: 5790
  Gene Symbol: FAM156B
  Gene Name: family with sequence similarity 156, member B
  Uniprot ID: Q8NDB6
  ENSP ID: ENSP00000424864

SEQ ID NO: 29674 - protein, 213 aa, Homo sapiens; identical to SEQ ID NO: 29654
  Payload ID: 5790
  Gene Symbol: FAM156B
  Gene Name: family with sequence similarity 156, member B
  Uniprot ID: Q8NDB6
  ENSP ID: ENSP00000469248

SEQ ID NO: 29675 - protein, 56 aa, Homo sapiens; identical to SEQ ID NO: 29666
  Payload ID: 5790
  Gene Symbol: FAM156B
  Gene Name: family with sequence similarity 156, member B
  ENSP ID: ENSP00000478064

SEQ ID NO: 29676 - protein, 3 aa, Homo sapiens
  Payload ID: 5790
  Gene Symbol: FAM156B
  Gene Name: family with sequence similarity 156, member B
  ENSP ID: ENSP00000479752
MDP

SEQ ID NO: 29677 - protein, 129 aa, Homo sapiens
  Payload ID: 5790
  Gene Symbol: FAM156B
  Gene Name: family with sequence similarity 156, member B
  ENSP ID: ENSP00000482608
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECR

SEQ ID NO: 29678 - protein, 213 aa, Homo sapiens; identical to SEQ ID NO: 29654
  Payload ID: 5790
  Gene Symbol: FAM156B
  Gene Name: family with sequence similarity 156, member B
  Uniprot ID: Q8NDB6
  ENSP ID: ENSP00000483008

SEQ ID NO: 29679 - protein, 49 aa, Homo sapiens
  Payload ID: 5790
  Gene Symbol: FAM156B
  Gene Name: family with sequence similarity 156, member B
  ENSP ID: ENSP00000484983
MDPLQKRNPASPSKSSPMTAAETSQEGPAPSQPSYSEQPMMGLSNLSPG

SEQ ID NO: 29680 - protein, 190 aa, Homo sapiens
  Payload ID: 5791
  Gene Symbol: FAM159A
  Gene Name: family with sequence similarity 159, member A
  Uniprot ID: Q6UWV7
  ENSP ID: ENSP00000429726
MSGACTSYVSAEQEVVRGFSCPRPGGEAAAVFCCGFRDHKYCCDDPHSFFPYEHSYMWWLSIGALIGLSVAAVVLLAFIVTACVLCYLFISSKPHTKLDLGLSLQTAGPEEVSPDCQGVNTGMAAEVPKVSPLQQSYSCLNPQLESNEGQAVNSKRLLHHCFMATVTTSDIPGSPEEASVPNPDLCGPVP

SEQ ID NO: 29681 - protein, 160 aa, Homo sapiens
  Payload ID: 5792
  Gene Symbol: FAM159B
  Gene Name: family with sequence similarity 159, member B
  Uniprot ID: A6NKW6
  ENSP ID: ENSP00000373726
MSEASRLCSGYYSLNQSFVEPFQCPRRGEGAALQYCCGFADLKYCCSEPGSYFPYKHSYMWSLSIGALIGLGIAALVLLAFVISVCVLCYLFLYTKPQRLDTGLKLQHLEASSTQEGKSNGKTKALNSNAASNATNETYYEADDIIQEKTMDATQIHIAY

SEQ ID NO: 29682 - protein, 70 aa, Homo sapiens
  Payload ID: 5792
  Gene Symbol: FAM159B
  Gene Name: family with sequence similarity 159, member B
  ENSP ID: ENSP00000426145
MSEASRLCSGYYSLNQSFVEPFQCPRRGEGAALQYCCGFADLKYCCSEPGSYFPYKHSYMWSLRSNLSVS

SEQ ID NO: 29683 - protein, 70 aa, Homo sapiens; identical to SEQ ID NO: 29682
  Payload ID: 5792
  Gene Symbol: FAM159B
  Gene Name: family with sequence similarity 159, member B
  ENSP ID: ENSP00000426194

SEQ ID NO: 29684 - protein, 1040 aa, Homo sapiens
  Payload ID: 5793
  Gene Symbol: FAM160A1
  Gene Name: family with sequence similarity 160, member A1
  Uniprot ID: Q05DH4
  ENSP ID: ENSP00000413196
MMSSVSTESKLQQAVSLQGVDPETCMIVFKNHWAQVVKILEKHDPLKNTQAKYGSIPPDEASAVQNYVEHMLFLLIEEQAKDAAMGPILEFVVSENIMEKLFLWSLRREFTDETKIEQLKMYEMLVTQSHQPLLHHKPILKPLMMLLSSCSGTTTPTVEEKLVVLLNQLCSILAKDPSILELFFHTSEDQGAANFLIFSLLIPFIHREGSVGQQARDALLFIMSLSAENTMVAHHIVENTYFCPVLATGLSGLYSSLPTKLEEKGEEWHCLLKDDWLLLPSLVQFMNSLEFCNAVIQVAHPLIRNQLVNYIYNGFLVPVLAPALHKVTVEEVMTTTAYLDLFLRSISEPALLEIFLRFILLHQHENVHILDTLTSRINTPFRLCVVSLALFRTLIGLHCEDVMLQLVLRYLIPCNHMMLSQRWAVKERDCYSVSAAKLLALTPVCCSSGITLTLGNQERDYILWSKCMHDTSGPVERPFPEAFSESACIVEYGKALDISYLQYLWEAHTNILRCMRDCRVWSALYDGDSPDPEMFLQSLTEEGSVSSACPVFGLPQQLPRKTGPQLAPRKDKSQTELEWDDSYDTGISSGADVGSPGPYDDLEVSGPPAPIDPPKHIQEMKKNALLLFKGSYIEESDFQDDVMVYRLCAEKDSEDMKDSQEEAARPPAEAQAEVQSVPINNGPLLSTQPETDSEEEWNRDNSDPFHSEPKEPKQEREPEAAPESNSELASPAPEAEHSSNLTAAHPESEELIAQYDQIIKELDSGAEGLMEQNYPTPDPLLLTKEEEGKEESKGEKEKEGKKELEDEEDDFDSFIAEMPAVETVPSPFVGRDEAAFASRHPVRTQSTPFTGPFISVVLSKLENMLENSLHVNLLLIGIITQLASYPQPLLRSFLLNTNMVFQPSVRSLYQVLASVKNKIEQFASVERDFPGLLIQAQQYLLFRVDMSDMTPAALTKDPIQEASRTGSGKNLLDGPPRVLQPFLTHRTKVAEAPPNLPLPVRNPMLAAALFPEFLKELAALAQEHSILCYKILGDFEDSCC

SEQ ID NO: 29685 - protein, 1040 aa, Homo sapiens; identical to SEQ ID NO: 29684
  Payload ID: 5793
  Gene Symbol: FAM160A1
  Gene Name: family with sequence similarity 160, member A1
  Uniprot ID: Q05DH4
  ENSP ID: ENSP00000421580

SEQ ID NO: 29686 - protein, 60 aa, Homo sapiens
  Payload ID: 5793
  Gene Symbol: FAM160A1
  Gene Name: family with sequence similarity 160, member A1
  ENSP ID: ENSP00000421948
MMSSVSTESKLQQAVSLQGVDPETCMIVFKNHWAQVVKILEKHDPLKNTQAKYGSIPPDE

SEQ ID NO: 29687 - protein, 40 aa, Homo sapiens
  Payload ID: 5793
  Gene Symbol: FAM160A1
  Gene Name: family with sequence similarity 160, member A1
  ENSP ID: ENSP00000424175
MMSSVSTESKLQQAVSLQGVDPETCMIVFKNHWAQVVKIL

SEQ ID NO: 29688 - protein, 13 aa, Homo sapiens
  Payload ID: 5793
  Gene Symbol: FAM160A1
  Gene Name: family with sequence similarity 160, member A1
  ENSP ID: ENSP00000425333
MMSSVSTESKLQQ

SEQ ID NO: 29689 - protein, 42 aa, Homo sapiens
  Payload ID: 5793
  Gene Symbol: FAM160A1
  Gene Name: family with sequence similarity 160, member A1
  ENSP ID: ENSP00000426677
MMSSVSTESKLQQAVSLQGVDPETCMIVFKNHWAQVVKILEK

SEQ ID NO: 29690 - protein, 986 aa, Homo sapiens
  Payload ID: 5794
  Gene Symbol: FAM160A2
  Gene Name: family with sequence similarity 160, member A2
  Uniprot ID: Q8N612
  ENSP ID: ENSP00000265978
MERMNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGGPSRETGRREDITGPGSPSVDSSSVTTVPRPSTPSRLALFLRQQSLGGSESPGPAPCSPGLSASPASSPGRRPTPAEEPGELEDNYLEYLREARRGVDRCVRACRTWSAPYDGERPSPEPSPFGSRTKKRSLLPEEDRNNVGEGEEEELGRRGRAGGAGEGPGHLPPPQLNGVPGSWPEGAKKVRLVPKEGAGELLEGISEGMAGLEGFGQELRELEVALSNGGTGSESPLEPPLPLEEEEAYESFTCPPEPPGPFLSSPLRTLNQLPSQPFTGPFMAVLFAKLENMLQNSVYVNFLLTGLVAQLACHPQPLLRSFLLNTNMVFQPSVKSLLQVLGSVKNKIENFAASQEDFPALLSKAKKYLIARGKLDWAEGPAAGPAPRRSDPLVKSRRPSLGELLLRHAHSPTRARQAAQLVLQPGRDGAGLGLSGGSPGASTPVLLTRGGAPERQGEALRVKNAVYCAVIFPEFLKELAAISQAHAVTSPFLLETSEEGSGPLISGCGPLNP

SEQ ID NO: 29691 - protein, 972 aa, Homo sapiens
  Payload ID: 5794
  Gene Symbol: FAM160A2
  Gene Name: family with sequence similarity 160, member A2
  Uniprot ID: Q8N612
  ENSP ID: ENSP00000416918
MERMNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGPGSPSVDSSSVTTVPRPSTPSRLALFLRQQSLGGSESPGPAPCSPGLSASPASSPGRRPTPAEEPGELEDNYLEYLREARRGVDRCVRACRTWSAPYDGERPSPEPSPFGSRTKKRSLLPEEDRNNVGEGEEEELGRRGRAGGAGEGPGHLPPPQLNGVPGSWPEGAKKVRLVPKEGAGELLEGISEGMAGLEGFGQELRELEVALSNGGTGSESPLEPPLPLEEEEAYESFTCPPEPPGPFLSSPLRTLNQLPSQPFTGPFMAVLFAKLENMLQNSVYVNFLLTGLVAQLACHPQPLLRSFLLNTNMVFQPSVKSLLQVLGSVKNKIENFAASQEDFPALLSKAKKYLIARGKLDWAEGPAAGPAPRRSDPLVKSRRPSLGELLLRHAHSPTRARQAAQLVLQPGRDGAGLGLSGGSPGASTPVLLTRGGAPERQGEALRVKNAVYCAVIFPEFLKELAAISQAHAVTSPFLLETSEEGSGPLISGCGPLNP

SEQ ID NO: 29692 - protein, 838 aa, Homo sapiens
  Payload ID: 5794
  Gene Symbol: FAM160A2
  Gene Name: family with sequence similarity 160, member A2
  ENSP ID: ENSP00000431773
MERMNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGPGSPSVDSSSVTTVPRPSTPSRLALFLRQQSLGGSESPGPAPCSPGLSASPASSPGRRPTPAEEPGELEDNYLEYLREARRGVDRCVRACRTWSAPYDGERPSPEPSPFGSRTKKRSLLPEEDRNNVGEGEEEELGRRGRAGGAGEGPGHLPPPQLNGVPGSWPEGAKKVRLVPKEGAGELLEGISEGMAGLEGFGQELRELEVALSNGGTGSESPLEPPLPLEEEEAYESFTCPPEPPGPFLSSPLRTLNQLPSQPFTGKLLSLGLPFCVLFACSRHVCAGFLDLLAMSFLCTCLAPHPSCLHHFQIRVMSYLCPCVCLYVFHACAGLSIDLHLSLVCMSYVHVPPLSLVWPFPAICN

SEQ ID NO: 29693 - protein, 101 aa, Homo sapiens
  Payload ID: 5795
  Gene Symbol: FAM160B1
  Gene Name: family with sequence similarity 160, member B1
  ENSP ID: ENSP00000358249
MFSKFTSILQHAVEALAPSLPLQEDFVYHWKAITHYYIETSDDKAPVTDTNIPSHLEQMLDILVQEENERESGETGPCMEYLLHHKILETLYTLGKADVSS

SEQ ID NO: 29694 - protein, 765 aa, Homo sapiens
  Payload ID: 5795
  Gene Symbol: FAM160B1
  Gene Name: family with sequence similarity 160, member B1
  Uniprot ID: Q5W0V3
  ENSP ID: ENSP00000358251
MFSKFTSILQHAVEALAPSLPLQEDFVYHWKAITHYYIETSDDKAPVTDTNIPSHLEQMLDILVQEENERESGETGPCMEYLLHHKILETLYTLGKADCPPGMKQQVLVFYTKLLGRIRQPLLPHINVHRPVQKLIRLCGEVLATPTENEEIQFLCIVCAKLKQDPYLVNFFLENKMKSLASKGVPNVISEDTLKGQDSLSTDTGQSRQPEELSGATGMEQTELEDEPPHQMDHLSTSLDNLSVTSLPEASVVCPNQDYNLVNSLLNLTRSPDGRIAVKACEGLMLLVSLPEPAAAKCLTQSTCLCELLTDRLASLYKALPQSVDPLDIETVEAINWGLDSYSHKEDASAFPGKRALISFLSWFDYCDQLIKEAQKTAAVALAKAVHERFFIGVMEPQLMQTSEMGILTSTALLHRIVRQVTSDVLLQEMVFFILGEQREPETLAEISRHPLRHRLIEHCDHISDEISIMTLRMFEHLLQKPNEHILYNLVLRNLEERNYTEYKPLCPEDKDVVENGLIAGAVDLEEDPLFTDISPENTLPNQEWLSSSPPATPDHPKNDGKTEVHKIVNSFLCLVPDDAKSSYHVEGTGYDTYLRDAHRQFRDYCAICLRWEWPGSPKALEKCNLEAAFFEGHFLKVLFDRMGRILDQPYDVNLQVTSVLSRLSLFPHPHIHEYLLDPYVNLAPGCRSLFSVIVRVVGDLMLRIQRIQDFTPKLLLVRKRLLGLEPEGPIIDHITLLEGVIVLEEFCKELAAIAFVKYHASSTP

SEQ ID NO: 29695 - protein, 738 aa, Homo sapiens
  Payload ID: 5795
  Gene Symbol: FAM160B1
  Gene Name: family with sequence similarity 160, member B1
  Uniprot ID: Q5W0V3
  ENSP ID: ENSP00000358253
MFSKFTSILQHAVEALAPSLPLQEDFVYHWKAITHYYIETSDDKAPVTDTNIPSHLEQMLDILVQEENERESGETGPCMEYLLHHKILETLYTLGKADCPPGMKQQVLVFYTKLLGRIRQPLLPHINVHRPVQKLIRLCGEVLATPTENEEIQFLCIVCAKLKQDPYLVNFFLENKMKSLASKGVPNVISEDTLKGQDSLSTDTGQSRQPEELSGATGMEQTELEDEPPHQMDHLSTSLDNLSVTSLPEASVVCPNQDYNLVNSLLNLTRSPDGRIAVKACEGLMLLVSLPEPAAAKCLTQSTCLCELLTDRLASLYKALPQSVDPLDIETVEAINWGLDSYSHKEDASAFPGKRALISFLSWFDYCDQLIKEAQKTAAVALAKAVHERFFIGVMEPQLMQTSEMGILTSTALLHRIVRQVTSDVLLQEMVFFILGEQREPETLAEISRHPLRHRLIEHCDHISDEISIMTLRMFEHLLQKPNEHILYNLVLRNLEERNYTEYKPLCPEDKDVVENGLIAGAVDLEEDPLFTDISPENTLPNQEWLSSSPPATPDHPKNDGKTEVHKIVNSFLCLVPDDAKSSYHVEGTGYDTYLRDAHRQFRDYCAICLRWEWPGSPKALEKCNLEAAFFEGHFLKVLFDRMGRILDQPYDVNLQVTSVLSRLSLFPHPHIHEYLLDPYVNLAPGCRSLFSVIVRVVGDLMLRIQRIQDFTPKLLLVRKRLLGLEPEGPMQTLPSWW

SEQ ID NO: 29696 - protein, 83 aa, Homo sapiens
  Payload ID: 5795
  Gene Symbol: FAM160B1
  Gene Name: family with sequence similarity 160, member B1
  ENSP ID: ENSP00000411924
LSLFPHPHIHEYLLDPYVNLAPGCRSLFSVIVRVVGDLMLRIQRIQDFTPKLLLVRKRLLGLEPEGPISDLEPVEALTVSSIC

SEQ ID NO: 29697 - protein, 743 aa, Homo sapiens
  Payload ID: 5796
  Gene Symbol: FAM160B2
  Gene Name: family with sequence similarity 160, member B2
  Uniprot ID: Q86V87
  ENSP ID: ENSP00000289921
MLSRLGALLQEAVGAREPSIDLLQAFVEHWKGITHYYIESTDESTPAKKTDIPWRLKQMLDILVYEEQQQAAAGEAGPCLEYLLQHKILETLCTLGKAEYPPGMRQQVFQFFSKVLAQVQHPLLHYLSVHRPVQKLLRLGGTASGSVTEKEEVQFTTVLCSKIQQDPELLAYILEGKKIVGRKKACGEPTALPKDTTSHGDKDCSHDGAPARPQLDGESCGAQALNSHMPAETEELDGGTTESNLITSLLGLCQSKKSRVALKAQENLLLLVSMASPAAATYLVQSSACCPAIVRHLCQLYRSMPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 29698 - protein, 51 aa, Homo sapiens
  Payload ID: 5796
  Gene Symbol: FAM160B2
  Gene Name: family with sequence similarity 160, member B2
  ENSP ID: ENSP00000395477
MLSRLGALLQEAVGATTPGPCWGAGRPSRHPGTWEVQALPVQVPTKARAQH

SEQ ID NO: 29699 - protein, 743 aa, Homo sapiens; identical to SEQ ID NO: 29697
  Payload ID: 5796
  Gene Symbol: FAM160B2
  Gene Name: family with sequence similarity 160, member B2
  Uniprot ID: Q86V87
  ENSP ID: ENSP00000403288

SEQ ID NO: 29700 - protein, 75 aa, Homo sapiens
  Payload ID: 5797
  Gene Symbol: FAM161A
  Gene Name: family with sequence similarity 161, member A
  ENSP ID: ENSP00000303170
MATSHRVAKLVASSLQTPVNPITGARVAQYEREDPLKALAAAEAILEDEEEEKVAQPAGASRWGFTMLARLVSDS

SEQ ID NO: 29701 - protein, 716 aa, Homo sapiens
  Payload ID: 5797
  Gene Symbol: FAM161A
  Gene Name: family with sequence similarity 161, member A
  Uniprot ID: Q3B820
  ENSP ID: ENSP00000385158
MATSHRVAKLVASSLQTPVNPITGARVAQYEREDPLKALAAAEAILEDEEEEKVAQPAGASADLNTSFSGVDEHAPISYEDFVNFPDIHHSNEEYFKKVEELKAAHIETMAKLEKMYQDKLHLKEVQPVVIREDSLSDSSRSVSEKNSYHPVSLMTSFSEPDLGQSSSLYVSSSEEELPNLEKEYPRKNRMMTYAKELINNMWTDFCVEDYIRCKDTGFHAAEKRRKKRKEWVPTITVPEPFQMMIREQKKKEESMKSKSDIEMVHKALKKQEEDPEYKKKFRANPVPASVFLPLYHDLVKQKEERRRSLKEKSKEALLASQKPFKFIAREEQKRAAREKQLRDFLKYKKKTNRFKARPIPRSTYGSTTNDKLKEEELYRNLRTQLRAQEHLQNSSPLPCRSACGCRNPRCPEQAVKLKCKHKVRCPTPDFEDLPERYQKHLSEHKSPKLLTVCKPFDLHASPHASIKREKILADIEADEENLKETRWPYLSPRRKSPVRCAGVNPVPCNCNPPVPTVSSRGREQAVRRSLEEKKMLEEERNRILTKQKQRMKELQKLLTTRAKAYDSHQSLAQISKSRVKCLRKSEKERMREYQRELEEREEKLKKRPLLFERVAQKNARMAAEKHYSNTLKALGISDEFVSKKGQSGKVLEYFNNQETKSVTEDKESFNEEEKIEERENGEENYFIDTNSQDSYKEKDEANEESEEEKSVEESH

SEQ ID NO: 29702 - protein, 660 aa, Homo sapiens
  Payload ID: 5797
  Gene Symbol: FAM161A
  Gene Name: family with sequence similarity 161, member A
  Uniprot ID: Q3B820
  ENSP ID: ENSP00000385893
MATSHRVAKLVASSLQTPVNPITGARVAQYEREDPLKALAAAEAILEDEEEEKVAQPAGASADLNTSFSGVDEHAPISYEDFVNFPDIHHSNEEYFKKVEELKAAHIETMAKLEKMYQDKLHLKEVQPVVIREDSLSDSSRSVSEKNSYHPVSLMTSFSEPDLGQSSSLYVSSSEEELPNLEKEYPRKNRMMTYAKELINNMWTDFCVEDYIRCKDTGFHAAEKRRKKRKEWVPTITVPEPFQMMIREQKKKEESMKSKSDIEMVHKALKKQEEDPEYKKKFRANPVPASVFLPLYHDLVKQKEERRRSLKEKSKEALLASQKPFKFIAREEQKRAAREKQLRDFLKYKKKTNRFKARPIPRSTYGSTTNDKLKEEELYRNLRTQLRAQEHLQNSSPLPCRSACGCRNPRCPEQAVKLKCKHKVRCPTPDFEDLPERYQKHLSEHKSPKLLTVCKPFDLHASPHASIKREKILADIEADEENLKETRWPYLSPRRKSPVRCAGVNPVPCNCNPPVPTVSSRGREQAVRKSEKERMREYQRELEEREEKLKKRPLLFERVAQKNARMAAEKHYSNTLKALGISDEFVSKKGQSGKVLEYFNNQETKSVTEDKESFNEEEKIEERENGEENYFIDTNSQDSYKEKDEANEESEEEKSVEESH

SEQ ID NO: 29703 - protein, 142 aa, Homo sapiens
  Payload ID: 5797
  Gene Symbol: FAM161A
  Gene Name: family with sequence similarity 161, member A
  ENSP ID: ENSP00000396105
MATSHRVAKLVASSLQTPVNPITGARVAQYEREDPLKALAAAEAILEDEEEEKVAQPAGASADLNTSFSGVDEHAPISYEDFVNFPDIHHSNEEYFKKVEELKAAHIETMAKLEKMYQDKLHLKEVQPVVIREDSLSDSSRA

SEQ ID NO: 29704 - protein, 601 aa, Homo sapiens
  Payload ID: 5797
  Gene Symbol: FAM161A
  Gene Name: family with sequence similarity 161, member A
  ENSP ID: ENSP00000416861
  MOD_RES (1)..(1): Any amino acid
XRVAKLVASSLQTPVNPITGARVAQYEREDPLKALAAAEAILEDEEEEKVAQPAGASADLNTSFSGVDEHAPISYEDFVNFPDIHHSNEEYFKKVEELKAAHIETMAKLEKMYQDKLHLKEVQPVVIREDSLSDSSRSVSEKNSYHPVSLMTSFSEPDLGQSSSLYVSSSEEELPNLEKEYPRKNRMMTYAKELINNMWTDFCVEDYIRCKDTGFHAAEKRRKKRKEWVPTITVPEPFQMMIREQKKKEESMKSKSDIEMVHKALKKQEEDPEYKKKFRANPVPASVFLPLYHDLVKQKEERRRSLKEKSKEALLASQKPFKFIAREEQKRAAREKQLRDFLKYKKKTNRFKARPIPRSTYGSTTNDKLKEEELYRNLRTQLRAQEHLQNSSPLPCRSACGCRNPRCPEQAVKLKCKHKVRCPTPDFEDLPERYQKHLSEHKSPKLLTVCKPFDLHASPHASIKREKILADIEADEENLKETRWPYLSPRRKSPVRCAGVNPVPCNCNPPVPTVSSRGREQAVRRSLEEKKMLEEERNRILTKQKQRMKELQKLLTTRAKAYDSHQSLAQISKSRVKCLRPGAMAHACNPSTLRGQDRQIT

SEQ ID NO: 29705 - protein, 710 aa, Homo sapiens
  Payload ID: 5798
  Gene Symbol: FAM161B
  Gene Name: family with sequence similarity 161, member B
  Uniprot ID: Q96MY7
  ENSP ID: ENSP00000286544
MRGENRPIGKRTLPPRAGWIGGCPGSQPDAKARKGWTLAPHSSRCHRCCHYRCHCRCCLCPAEMTVGRPEGAPGGAEGSRQIFPPESFADTEAGEELSGDGLVLPRASKLDEFLSPEEEIDSTSDSTGSIYQNLQELKQKGRWCLLESLFQSDPESDENLSEDEEDLESFFQDKDRGMVQVQCPQALRCGSTRRCSSLNNLPSNIPRPQTQPPSGSRPPSQHRSVSSWASSITVPRPFRMTLREARKKAEWLGSPASFEQERQRAQRQGEEEAECHRQFRAQPVPAHVYLPLYQEIMERSEARRQAGIQKRKELLLSSLKPFSFLEKEEQLKEAARQRDLAATAEAKISKQKATRRIPKSILEPALGDKLQEAELFRKIRIQMRALDMLQMASSPIASSSNRANPQPRTATRTQQEKLGFLHTNFRFQPRVNPVVPDYEGLYKAFQRRAAKRRETQEATRNKPFLLRTANLRHPQRPCDAATTGRRQDSPQPPATPLPRSRSLSGLASLSANTLPVHITDATRKRESAVRSALEKKNKADESIQWLEIHKKKSQAMSKSVTLRAKAMDPHKSLEEVFKAKLKENRNNDRKRAKEYKKELEEMKQRIQTRPYLFEQVAKDLAKKEAEQWYLDTLKQAGLEEDFVRNKGQGTRAVQEKETKIKDFPRFQETTKLSIRDPEQGLEGSLEQPASPRKVLEELSHQSPENLVSLA

SEQ ID NO: 29706 - protein, 144 aa, Homo sapiens
  Payload ID: 5798
  Gene Symbol: FAM161B
  Gene Name: family with sequence similarity 161, member B
  ENSP ID: ENSP00000450889
  MOD_RES (1)..(1): Any amino acid
XNKADESIQWLEIHKKKSQAMSKSVTLRAKAMDPHKSLEEVFKAKLKENRNNDRKRAKEYKKELEEMKQRIQTRPYLFEQVAKDLAKKEAEQWYLDTLKQAGLEEDFVRNKGQGTRAVQEKETKIKDFPRCVFFGGDRVTITWA

SEQ ID NO: 29707 - protein, 144 aa, Homo sapiens
  Payload ID: 5799
  Gene Symbol: FAM162A
  Gene Name: family with sequence similarity 162, member A
  ENSP ID: ENSP00000232125
MRSCFRLCERDVSSSLRLTRSSDLKRINGFCTKPQESPGAPSRTYNRVPLHKPTDWQKKILIWSGRFKKEDEIPETVSLEMLDAAKNKMRVKISYLMIALTVVGCIFMVIEGKKAAQRHETLTSLNLEKKARLKEEAAMKAKTE

SEQ ID NO: 29708 - protein, 154 aa, Homo sapiens
  Payload ID: 5799
  Gene Symbol: FAM162A
  Gene Name: family with sequence similarity 162, member A
  Uniprot ID: Q96A26
  ENSP ID: ENSP00000419088
MGSLSGLRLAAGSCFRLCERDVSSSLRLTRSSDLKRINGFCTKPQESPGAPSRTYNRVPLHKPTDWQKKILIWSGRFKKEDEIPETVSLEMLDAAKNKMRVKISYLMIALTVVGCIFMVIEGKKAAQRHETLTSLNLEKKARLKEEAAMKAKTE

SEQ ID NO: 29709 - protein, 141 aa, Homo sapiens
  Payload ID: 5799
  Gene Symbol: FAM162A
  Gene Name: family with sequence similarity 162, member A
  ENSP ID: ENSP00000419491
MGSLSGLRLAAGSCFRLCERDVSSSLRLTRSSDLKRINGFCTKPQESPGAPSRTYNRVPLHKPTDWQKKILIWSGRFKKEDEIPETVSLEMLDAAKNKMRVKISYLMIALTVVGCIFMVIEGKKVRRGFFSIQYVCSPPRT

SEQ ID NO: 29710 - protein, 162 aa, Homo sapiens
  Payload ID: 5800
  Gene Symbol: FAM162B
  Gene Name: family with sequence similarity 162, member B
  Uniprot ID: Q5T6X4
  ENSP ID: ENSP00000357545
MLRAVGSLLRLGRGLTVRCGPGAPLEATRRPAPALPPRGLPCYSSGGAPSNSGPQGHGEIHRVPTQRRPSQFDKKILLWTGRFKSMEEIPPRIPPEMIDTARNKARVKACYIMIGLTIIACFAVIVSAKRAVERHESLTSWNLAKKAKWREEAALAAQAKAK

SEQ ID NO: 29711 - protein, 167 aa, Homo sapiens
  Payload ID: 5801
  Gene Symbol: FAM163A
  Gene Name: family with sequence similarity 163, member A
  Uniprot ID: Q96GL9
  ENSP ID: ENSP00000354891
MTAGTVVITGGILATVILLCIIAVLCYCRLQYYCCKKSGTEVADEEEEREHDLPTHPRGPTCNACSSQALDGRGSLAPLTSEPCSQPCGVAASHCTTCSPYSSPFYIRTADMVPNGGGGERLSFAPTYYKEGGPPSLKLAAPQSYPVTWPGSGREAFTNPRAISTDV

SEQ ID NO: 29712 - protein, 166 aa, Homo sapiens
  Payload ID: 5802
  Gene Symbol: FAM163B
  Gene Name: family with sequence similarity 163, member B
  Uniprot ID: P0C2L3
  ENSP ID: ENSP00000349336
MTAGTVVITGGILATVILLCIIAVLCYCRLQYYCCKKDESEEDEEEPDFAVHSHLPPLHSNRNLVLTNGPALYPTASTSFSQKSPQARALCRSCSHCEPPTFFLQEPPEEEEDVLNGGERVLYKSVSQEDVELPPGGFGGLQALNPNRLSAMREAFARSRSISTDV

SEQ ID NO: 29713 - protein, 166 aa, Homo sapiens; identical to SEQ ID NO: 29712
  Payload ID: 5802
  Gene Symbol: FAM163B
  Gene Name: family with sequence similarity 163, member B
  Uniprot ID: P0C2L3
  ENSP ID: ENSP00000419867

SEQ ID NO: 29714 - protein, 317 aa, Homo sapiens
  Payload ID: 5803
  Gene Symbol: FAM166A
  Gene Name: family with sequence similarity 166, member A
  Uniprot ID: Q6J272
  ENSP ID: ENSP00000344729
MTTTQKHDLFTPEPHYVPGYAGFFPQLRYQVGNTYGRTTGQLLTDPSVQKSPCSVLSPMSKPKFIEDFSQSKPPRVPCQDLTEPYIPHYTSLKPSKNFEILGQLPPLEVDAQEPPGVENIPRQILLPAGFTPDTPHPPCPPGRKGDSRDLGHPVYGEEAWKSATPVCEAPRQHQLYHCQRDEYPPPARRQQETLDVGSFQRLPQLDHPNLIQRKAISGYAGFIPRFTWVMGLNYRDGVMQAMDEFDKSQFLFRNPHCDLGEKLPGTHWPSNHIYSSQGLIPFYMGFIPAMQDNYALTFGNSTRRAYWKEWAKRNHTL

SEQ ID NO: 29715 - protein, 223 aa, Homo sapiens
  Payload ID: 5803
  Gene Symbol: FAM166A
  Gene Name: family with sequence similarity 166, member A
  ENSP ID: ENSP00000420741
MTTTQKHDLFTPEPHYVPGYAGFFPQLRYQVGNTYGRTTGQLLTDPSVQKSPCSVLSPMSKPKFIEDFSQSKPPRVPCQDLTEPYIPHYTSELPVPSPAPSCARLPVPALTGCPVGTGLKPSKNFEILGQLPPLEVDAQEPPGVENIPRQILLPAGFTPDTPHPPCPPGRKGDSRDLGHPVYGEEAWKSATPVCEAPRQHQLYHCQRDEYPPPARRQQETLDV

SEQ ID NO: 29716 - protein, 275 aa, Homo sapiens
  Payload ID: 5804
  Gene Symbol: FAM166B
  Gene Name: family with sequence similarity 166, member B
  Uniprot ID: A8MTA8
  ENSP ID: ENSP00000382646
MAVASTFIPGLNPQNPHYIPGYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKQGSEELPKEAKGRKDTEKDQVPEPEGQLEEPTLEVVEQASPYSMDDRDPRKFFMSGFTGYVPCARFLFGSSFPVLTNQALQEFGQKHSPGSAQDPKHLPPLPRTYPQNLGLLPNYGGYVPGYKFQFGHTFGHLTHDALGLSTFQKQLLA

SEQ ID NO: 29717 - protein, 216 aa, Homo sapiens
  Payload ID: 5804
  Gene Symbol: FAM166B
  Gene Name: family with sequence similarity 166, member B
  Uniprot ID: A8MTA8
  ENSP ID: ENSP00000412746
MAVASTFIPGLNPQNPHYIPGYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKQGSEELPKEAKGRKDTEKDQVPEPEGQLEEPTLEVVEQASPYSMDDRDPRKFFMSGTAGIWAEALTRQCPGPQTSPPTSQNIPSEPGSFT

SEQ ID NO: 29718 - protein, 259 aa, Homo sapiens
  Payload ID: 5804
  Gene Symbol: FAM166B
  Gene Name: family with sequence similarity 166, member B
  ENSP ID: ENSP00000480923
MAVASTFIPGLNPQNPHYIPGYTGHCPLLRFSVGQTYGQVTGQLLRGPPGLAWPPVHRTLLPPIRPPRSPEVPRESLPVRRGQERLSSSMIPGYTGFVPRAQFIFAKNCSQVWAEALSDFTHLHEKQGSEELPKEAKGRKDTEKDQVPEPEGQLEEPTLEVVEQASPYSMDDRDPRKFFMSAFLCSPTRHCRNLGRSTHQAVPRTPNISPHFPEHTLRTWVFYNYGGYVPGYKFQFGHTFGHLTHDALGLSTFQKQLLA

SEQ ID NO: 29719 - protein, 214 aa, Homo sapiens
  Payload ID: 5805
  Gene Symbol: FAM167A
  Gene Name: family with sequence similarity 167, member A
  Uniprot ID: Q96KS9
  ENSP ID: ENSP00000284486
MSVPQIHVEEVGAEEGAGAAAPPDDHLRSLKALTEKLRLETRRPSYLEWQARLEEHTWPFPRPAAEPQASLEEGERGGQEPLLPLREAGQHPPSARSASQGARPLSTGKLEGFQSIDEAIAWLRKELTEMRLQDQQLARQLMRLRGDINKLKIEHTCRLHRRMLNDATYELEERDELADLFCDSPLASSFSLSTPLKLIGVTKMNINSRRFSLC

SEQ ID NO: 29720 - protein, 91 aa, Homo sapiens
  Payload ID: 5805
  Gene Symbol: FAM167A
  Gene Name: family with sequence similarity 167, member A
  ENSP ID: ENSP00000431951
MSVPQIHVEEVGAEEGAGAAAPPDDHLRSLKALTEKLRLETRRPSYLEWQARLEEHTWPFPRPAAEPQASLEEGERGGQEPLLPLREAGQH

SEQ ID NO: 29721 - protein, 214 aa, Homo sapiens; identical to SEQ ID NO: 29719
  Payload ID: 5805
  Gene Symbol: FAM167A
  Gene Name: family with sequence similarity 167, member A
  Uniprot ID: Q96KS9
  ENSP ID: ENSP00000432232

SEQ ID NO: 29722 - protein, 214 aa, Homo sapiens; identical to SEQ ID NO: 29719
  Payload ID: 5805
  Gene Symbol: FAM167A
  Gene Name: family with sequence similarity 167, member A
  Uniprot ID: Q96KS9
  ENSP ID: ENSP00000436655

SEQ ID NO: 29723 - protein, 163 aa, Homo sapiens
  Payload ID: 5806
  Gene Symbol: FAM167B
  Gene Name: family with sequence similarity 167, member B
  Uniprot ID: Q9BTA0
  ENSP ID: ENSP00000362684
MSLGLLKFQAVGEEDEEDEEGESLDSVKALTAKLQLQTRRPSYLEWTAQVQSQAWRRAQAKPGPGGPGDICGFDSMDSALEWLRRELREMQAQDRQLAGQLLRLRAQLHRLKMDQACHLHQELLDEAELELELEPGAGLALAPLLRHLGLTRMNISARRFTLC

SEQ ID NO: 29724 - protein, 244 aa, Homo sapiens
  Payload ID: 5807
  Gene Symbol: FAM168A
  Gene Name: family with sequence similarity 168, member A
  Uniprot ID: Q92567
  ENSP ID: ENSP00000064778
MNPVYSPVQPGAPYGNPKNMAYTGYPTAYPAAAPAYNPSLYPTNSPSYAPEFQFLHSAYATLLMKQAWPQNSSSCGTEGTFHLPVDTGTENRTYQASSAAFRYTAGTPYKVPPTQSNTAPPPYSPSPNPYQTAMYPIRSAYPQQNLYAQGAYYTQPVYAAQPHVIHHTTVVQPNSIPSAIYPAPVAAPRTNGVAMGMVAGTTMAMSAGTLLTTPQHTAIGAHPVSMPTYRAQGTPAYSYVPPHW

SEQ ID NO: 29725 - protein, 235 aa, Homo sapiens
  Payload ID: 5807
  Gene Symbol: FAM168A
  Gene Name: family with sequence similarity 168, member A
  Uniprot ID: Q92567
  ENSP ID: ENSP00000348852
MNPVYSPVQPGAPYGNPKNMAYTGYPTAYPAAAPAYNPSLYPTNSPSYAPATLLMKQAWPQNSSSCGTEGTFHLPVDTGTENRTYQASSAAFRYTAGTPYKVPPTQSNTAPPPYSPSPNPYQTAMYPIRSAYPQQNLYAQGAYYTQPVYAAQPHVIHHTTVVQPNSIPSAIYPAPVAAPRTNGVAMGMVAGTTMAMSAGTLLTTPQHTAIGAHPVSMPTYRAQGTPAYSYVPPHW

SEQ ID NO: 29726 - protein, 129 aa, Homo sapiens
  Payload ID: 5807
  Gene Symbol: FAM168A
  Gene Name: family with sequence similarity 168, member A
  Uniprot ID: Q92567
  ENSP ID: ENSP00000390501
MNPVYSPVQPGAPYGNPKNMAYTGYPTAYPAAAPAYNPSLYPTNSPSYAPATLLMKQAWPQNSSSCGTEGTFHLPVDTGTENRTYQASSAAFSTLLTTPQHTAIGAHPVSMPTYRAQGTPAYSYVPPHW

SEQ ID NO: 29727 - protein, 195 aa, Homo sapiens
  Payload ID: 5808
  Gene Symbol: FAM168B
  Gene Name: family with sequence similarity 168, member B
  Uniprot ID: A1KXE4
  ENSP ID: ENSP00000374565
MNPVYSPGSSGVPYANAKGIGYPAGFPMGYAAAAPAYSPNMYPGANPTFQTGYTPGTPYKVSCSPTSGAVPPYSSSPNPYQTAVYPVRSAYPQQSPYAQQGTYYTQPLYAAPPHVIHHTTVVQPNGMPATVYPAPIPPPRGNGVTMGMVAGTTMAMSAGTLLTAHSPTPVAPHPVTVPTYRAPGTPTYSYVPPQW

SEQ ID NO: 29728 - protein, 195 aa, Homo sapiens; identical to SEQ ID NO: 29727
  Payload ID: 5808
  Gene Symbol: FAM168B
  Gene Name: family with sequence similarity 168, member B
  Uniprot ID: A1KXE4
  ENSP ID: ENSP00000387051

SEQ ID NO: 29729 - protein, 670 aa, Homo sapiens
  Payload ID: 5809
  Gene Symbol: FAM169A
  Gene Name: family with sequence similarity 169, member A
  Uniprot ID: Q9Y6X4
  ENSP ID: ENSP00000373808
MAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQVSTLGERVVLYVLNRIIYRKQEMERNEIPFLCHSSTDYAKILWKKGEAIGFYSVKPTGSICASFLTQSYQLPVLDTMFLRKKYRGKDFGLHMLEDFVDSFTEDALGLRYPLSSLMYTACKQYFEKYPGDHELLWEVEGVGHWYQRIPVTRALQREALKILALSQNEPKRPMSGEYGPASVPEYEARTEDNQSSEMQLTIDSLKDAFASTSEGHDKTSVSTHTRSGNLKRPKIGKRFQDSEFSSSQGEDEKTSQTSLTASINKLESTARPSESSEEFLEEEPEQRGIEFEDESSDRDARPALETQPQQEKQDGEKESELEPMNGEIMDDSLKTSLITEEEDSTSEVLDEELKLQPFNSSEDSTNLVPLVVESSKPPEVDAPDKTPRIPDSEMLMDEGTSDEKGHMEEKLSLLPRKKAHLGSSDNVATMSNEERSDGGFPNSVIAEFSEEPVSENLSPNTTSSLEDQGEEGVSEPQETSTALPQSSLIEVELEDVPFSQNAGQKNQSEEQSEASSEQLDQFTQSAEKAVDSSSEEIEVEVPVVDRRNLRRKAKGHKGPAKKKAKLT

SEQ ID NO: 29730 - protein, 86 aa, Homo sapiens
  Payload ID: 5809
  Gene Symbol: FAM169A
  Gene Name: family with sequence similarity 169, member A
  ENSP ID: ENSP00000421451
MAFPVDMLENCSHEELENSAEDYMSDLRCGDPENPECFSLLNITIPISLSNVGFVPLYGGDQTQKILALFAPEDSLTAVALYLADQ

SEQ ID NO: 29731 - protein, 222 aa, Homo sapiens
  Payload ID: 5809
  Gene Symbol: FAM169A
  Gene Name: family with sequence similarity 169, member A
  ENSP ID: ENSP00000423631
MAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQVSTLGERVVLYVLNRIIYRKQEMERNEIPFLCHSSTDYAKILWKKGEAIGFYSVKPTGSICASFLTQSYQLPVLDTMFLRKKYRGKDFGLHMLEDFVDSFTEDALGLRYPLSSLMY

SEQ ID NO: 29732 - protein, 175 aa, Homo sapiens
  Payload ID: 5809
  Gene Symbol: FAM169A
  Gene Name: family with sequence similarity 169, member A
  ENSP ID: ENSP00000423883
MAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQVSTLGERVVLYVLNRIIYRKQEMERNEIPFLCHSSTDYAKILWKKGEAIGFYSVKPTGSICASFLTQSY

SEQ ID NO: 29733 - protein, 127 aa, Homo sapiens
  Payload ID: 5809
  Gene Symbol: FAM169A
  Gene Name: family with sequence similarity 169, member A
  Uniprot ID: Q9Y6X4
  ENSP ID: ENSP00000423905
MAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQEAYVPLFLPKVTNCQFLIQCF

SEQ ID NO: 29734 - protein, 610 aa, Homo sapiens
  Payload ID: 5809
  Gene Symbol: FAM169A
  Gene Name: family with sequence similarity 169, member A
  ENSP ID: ENSP00000424578
MAFPVDMLENCSHEELENSAEDYMSDLRCGDPENPECFSLLNITIPISLSNVGFVPLYGGDQTQKILALFAPEDSLTAVALYLADQWWAIDDIVKTSVPSREGLKQVSTLGERVVLYVLNRIIYRKQEMERNEIPFLCHSSTDYAKILWKKGEAIGFYSVKPTACKQYFEKYPGDHELLWEVEGVGHWYQRIPVTRALQREALKILALSQNEPKRPMSGEYGPASVPEYEARTEDNQSSEMQLTIDSLKDAFASTSEGHDKTSVSTHTRSGNLKRPKIGKRFQDSEFSSSQGEDEKTSQTSLTASINKLESTARPSESSEEFLEEEPEQRGIEFEDESSDRDARPALETQPQQEKQDGEKESELEPMNGEIMDDSLKTSLITEEEDSTSEVLDEELKLQPFNSSEDSTNLVPLVVESSKPPEVDAPDKTPRIPDSEMLMDEGTSDEKGHMEEKLSLLPRKKAHLGSSDNVATMSNEERSDGGFPNSVIAEFSEEPVSENLSPNTTSSLEDQGEEGVSEPQETSTALPQSSLIEVELEDVPFSQNAGQKNQSEEQSEASSEQLDQFTQSAEKAVDSSSEEIEVEVPVVDRRNLRRKAKGHKGPAKKKAKLT

SEQ ID NO: 29735 - protein, 127 aa, Homo sapiens; identical to SEQ ID NO: 29733
  Payload ID: 5809
  Gene Symbol: FAM169A
  Gene Name: family with sequence similarity 169, member A
  Uniprot ID: Q9Y6X4
  ENSP ID: ENSP00000425319

SEQ ID NO: 29736 - protein, 191 aa, Homo sapiens
  Payload ID: 5810
  Gene Symbol: FAM169B
  Gene Name: family with sequence similarity 169, member B
  ENSP ID: ENSP00000332615
KVQSFGERVVLFILNAIIFGRLERNLDDDDMFFLPHSVKEQAKILWRRGAAVGFYTTKMKGRLCGDGTGACYLLPVFDTVFIRRKHWHRGLGTAMLRDFCETFPEDEALGVSCSMSPAMYQAHPGNSEDVSRHARTSQNDRPRQPAPGDGSKERMCGEELEDTKDDPECGVEEEDAGLAGQPPGKLTRSSP

SEQ ID NO: 29737 - protein, 192 aa, Homo sapiens
  Payload ID: 5810
  Gene Symbol: FAM169B
  Gene Name: family with sequence similarity 169, member B
  Uniprot ID: Q8N8A8
  ENSP ID: ENSP00000453554
MKVQSFGERVVLFILNAIIFGRLERNLDDDDMFFLPHSVKEQAKILWRRGAAVGFYTTKMKGRLCGDGTGACYLLPVFDTVFIRRKHWHRGLGTAMLRDFCETFPEDEALGVSCSMSPAMYQAHPGNSEDVSRHARTSQNDRPRQPAPGDGSKERMCGEELEDTKDDPECGVEEEDAGLAGQPPGKLTRSSP

SEQ ID NO: 29738 - protein, 329 aa, Homo sapiens
  Payload ID: 5811
  Gene Symbol: FAM170A
  Gene Name: family with sequence similarity 170, member A
  Uniprot ID: A1A519
  ENSP ID: ENSP00000334285
MKRRQKRKHLENEESQETAEKGGGMSKSQEDALQPGSTRVAKGWSQGVGEVTSTSEYCSCVSSSRKLIHSGIQRIHRDSPQPQSPLAQVQERGETPPRSQHVSLSSYSSYKTCVSSLCVNKEERGMKIYYMQVQMNKGVAVSWETEETLESLEKQPRMEEVTLSEVVRVGTPPSDVSTRNLLSDSEPSGEEKEHEERTESDSLPGSPTVEDTPRAKTPDWLVTMENGFRCMACCRVFTTMEALQEHVQFGIREGFSCHVFHLTMAQLTGNMESESTQDEQEEENGNEKEEEEKPEAKEEEGQPTEEDLGLRRSWSQCPGCVFHSPKDRN

SEQ ID NO: 29739 - protein, 282 aa, Homo sapiens
  Payload ID: 5811
  Gene Symbol: FAM170A
  Gene Name: family with sequence similarity 170, member A
  Uniprot ID: A1A519
  ENSP ID: ENSP00000368873
MKRRQKRKHLENEESQETAEKGGGIQRIHRDSPQPQSPLAQVQERGETPPRSQHVSLSSYSSYKTCVSSLCVNKEERGMKIYYMQVQMNKGVAVSWETEETLESLEKQPRMEEVTLSEVVRVGTPPSDVSTRNLLSDSEPSGEEKEHEERTESDSLPGSPTVEDTPRAKTPDWLVTMENGFRCMACCRVFTTMEALQEHVQFGIREGFSCHVFHLTMAQLTGNMESESTQDEQEEENGNEKEEEEKPEAKEEEGQPTEEDLGLRRSWSQCPGCVFHSPKDRN

SEQ ID NO: 29740 - protein, 330 aa, Homo sapiens
  Payload ID: 5811
  Gene Symbol: FAM170A
  Gene Name: family with sequence similarity 170, member A
  Uniprot ID: A1A519
  ENSP ID: ENSP00000422684
MKRRQKRKHLENEESQETAEKGGGMSKSQEDALQPGSTRVAKGWSQGVGEVTSTSEYCSCVSSSRKLIHSGIQRIHRDSPQPQSPLAQVQERGETPPRSQHVSLSSYSSYKTCVSSLCVNKEERGMKIYYMQVQMNKGVAVSWETEETLESLEKQPRMEEVTLSEVVRVGTPPSDVSTRNLLSDSEPSGEEKEHEERTESDSLPGSPTVEDTPRAKTPDWLVTMENGFRCMACCRVFTTMEALQEHVQFGIREGFSCHVFHLTMAQLTGNMESESTQDEQEEENGNEKEEEEKPEAKEEEGQPTEEDLGLRRSWSQCPGCVFHSPKDRNS

SEQ ID NO: 29741 - protein, 186 aa, Homo sapiens
  Payload ID: 5811
  Gene Symbol: FAM170A
  Gene Name: family with sequence similarity 170, member A
  ENSP ID: ENSP00000423697
MKRRQKRKHLENEESQETAEKGGGMSKSQEDALQPGSTRVAKGWSQGVGEVTSTSEYCSCVSSSRKLIHSGIQRIHRDSPQPQSPLAQVQERGETPPRSQHVSLSSYSSYKTCVSSLCVNKEERGMKIYYMQVQMNKGVAVSWETEETLESLEKQPRMEEVTLSEVVRQLRLMGQKILEDGVAFSC

SEQ ID NO: 29742 - protein, 283 aa, Homo sapiens
  Payload ID: 5811
  Gene Symbol: FAM170A
  Gene Name: family with sequence similarity 170, member A
  ENSP ID: ENSP00000425939
MKRRQKRKHLENEESQETAEKGGGIQRIHRDSPQPQSPLAQVQERGETPPRSQHVSLSSYSSYKTCVSSLCVNKEERGMKIYYMQVQMNKGVAVSWETEETLESLEKQPRMEEVTLSEVVRVGTPPSDVSTRNLLSDSEPSGEEKEHEERTESDSLPGSPTVEDTPRAKTPDWLVTMENGFRCMACCRVFTTMEALQEHVQFGIREGFSCHVFHLTMAQLTGNMESESTQDEQEEENGNEKEEEEKPEAKEEEGQPTEEDLGLRRSWSQCPGCVFHSPKDRNS

SEQ ID NO: 29743 - protein, 329 aa, Homo sapiens; identical to SEQ ID NO: 29738
  Payload ID: 5811
  Gene Symbol: FAM170A
  Gene Name: family with sequence similarity 170, member A
  Uniprot ID: A1A519
  ENSP ID: ENSP00000482552

SEQ ID NO: 29744 - protein, 282 aa, Homo sapiens; identical to SEQ ID NO: 29739
  Payload ID: 5811
  Gene Symbol: FAM170A
  Gene Name: family with sequence similarity 170, member A
  Uniprot ID: A1A519
  ENSP ID: ENSP00000483075

SEQ ID NO: 29745 - protein, 283 aa, Homo sapiens
  Payload ID: 5812
  Gene Symbol: FAM170B
  Gene Name: family with sequence similarity 170, member B
  Uniprot ID: A6NMN3
  ENSP ID: ENSP00000308292
MKCYFTDHRGEQSPTDGTTLSLTSPESTEESVEVFWPGTIQREGSSPRPGPAIPREEGLYFAARDRGMRDWSSSPSSESSEYQSYSQYQSCCSCMCDEDNAAPQSVCAFYTHVQTVRGVAVAWETEAGFEPVTRKPRIHEAQFIKRQRWNGSSFEMASNTDMRWDLEACKSNCSPEPEDIDLLECCLQELREPPDWLVTTNYGVRCVACCRVLPSLDALLEHAQHGIREGFSCQIFFEEMLERRRAQGQAHDQQLEEEQSPSDNSECSRPQGEVLSAQQQEKQ

SEQ ID NO: 29746 - protein, 890 aa, Homo sapiens
  Payload ID: 5813
  Gene Symbol: FAM171A1
  Gene Name: family with sequence similarity 171, member A1
  Uniprot ID: Q5VUB5
  ENSP ID: ENSP00000367356
MSRSATLLLCLLGCHVWKAVTKTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGARPQPRVHFQRRALRLPENTSYSDLTAFLTAASSPSEVDSFPYLRGLDGNGTGNSTRHDLTPVTAVSVHLLSSNGTPVLVDGPIYVTVPLATQSSLRHNAYVAAWRFDQKLGTWLKSGLGLVHQEGSQLTWTYIAPQLGYWVAAMSPPIPGPVVTQDITTYHTVFLLAILGGMAFILLVLLCLLLYYCRRKCLKPRQHHRKLQLPAGLESSKRDQSTSMSHINLLFSRRASEFPGPLSVTSHGRPEAPGTKELMSGVHLEMMSPGGEGDLHTPMLKLSYSTSQEFSSREELLSCKEEDKSQISFDNLTPSGTLGKDYHKSVEVFPLKARKSMEREGYESSGNDDYRGSYNTVLSQPLFEKQDREGPASTGSKLTIQEHLYPAPSSPEKEQLLDRRPTECMMSRSVDHLERPTSFPRPGQLICCSSVDQVNDSVYRKVLPALVIPAHYMKLPGDHSYVSQPLVVPADQQLEIERLQAELSNPHAGIFPHPSSQIQPQPLSSQAISQQHLQDAGTREWSPQNASMSESLSIPASLNDAALAQMNSEVQLLTEKALMELGGGKPLPHPRAWFVSLDGRSNAHVRHSYIDLQRAGRNGSNDASLDSGVDMNEPKSARKGRGDALSLQQNYPPVQEHQQKEPRAPDSTAYTQLVYLDDVEQSGSECGTTVCTPEDSALRCLLEGSSRRSGGQLPSLQEETTRRTADAPSEPAASPHQRRSAHEEEEDDDDDDQGEDKKSPWQKREERPLMAFNIK

SEQ ID NO: 29747 - protein, 198 aa, Homo sapiens
  Payload ID: 5813
  Gene Symbol: FAM171A1
  Gene Name: family with sequence similarity 171, member A1
  ENSP ID: ENSP00000407796
MSRSATLLLCLLGCHVWKAVTKTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGNSTRHDLTPVTAVSVHLLSSNGTPVLVDGPIYVTVPLATQSSLRHNAYVAAWRFDQKL

SEQ ID NO: 29748 - protein, 826 aa, Homo sapiens
  Payload ID: 5814
  Gene Symbol: FAM171A2
  Gene Name: family with sequence similarity 171, member A2
  Uniprot ID: A8MVW0
  ENSP ID: ENSP00000293443
MPPASGPSVLARLLPLLGLLLGSASRAPGKSPPEPPSPQEILIKVQVYVSGELVPLARASVDVFGNRTLLAAGTTDSEGVATLPLSYRLGTWVLVTAARPGFLTNSVPWRVDKLPLYASVSLYLLPERPATLILYEDLVHILLGSPGARSQPLVQFQRRAARLPVSSTYSQLWASLTPASTQQEMRAFPAFLGTEASSSGNGSWLELMPLTAVSVHLLTGNGTEVPLSGPIHLSLPVPSETRALTVGTSIPAWRFDPKSGLWVRNGTGVIRKEGRQLYWTFVSPQLGYWVAAMASPTAGLVTITSGIQDIGTYHTIFLLTILAALALLVLILLCLLIYYCRRRCLKPRQQHRKLQLSGPSDGNKRDQATSMSQLHLICGGPLEPAPSGDPEAPPPGPLHSAFSSSRDLASSRDDFFRTKPRSASRPAAEPSGARGGESAGLKGARSAEGPGGLEPGLEEHRRGPSGAAAFLHEPPSPPPPFDHYLGHKGAAEGKTPDFLLSQSVDQLARPPSLGQAGQLIFCGSIDHLKDNVYRNVMPTLVIPAHYVRLGGEAGAAGVGDEPAPPEGTAPGPARAFPQPDPQRPQMPGHSGPGGEGGGGGGEGWGAGRAAPVSGSVTIPVLFNESTMAQLNGELQALTEKKLLELGVKPHPRAWFVSLDGRSNSQVRHSYIDLQAGGGARSTDASLDSGVDVHEARPARRRPAREERERAPPAAPPPPPAPPRLALSEDTEPSSSESRTGLCSPEDNSLTPLLDEVAAPEGRAATVPRGRGRSRGDSSRSSASELRRDSLTSPEDELGAEVGDEAGDKKSPWQRREERPLMVFNVK

SEQ ID NO: 29749 - protein, 159 aa, Homo sapiens
  Payload ID: 5814
  Gene Symbol: FAM171A2
  Gene Name: family with sequence similarity 171, member A2
  ENSP ID: ENSP00000466195
MPPASGPSVLARLLPLLGLLLGSASRAPGKSPPEPPSPQEILIKVQVYVSGELVPLARASVDVFGNRTLLAAGTTDSEGVATLPLSYRLGTWVLVTAARPGFLTNSVPWRVDKLPLYASVSLYLLPERPATLILYEDLVHILLGSPGCARHCGWCWEPR

SEQ ID NO: 29750 - protein, 159 aa, Homo sapiens; identical to SEQ ID NO: 29749
  Payload ID: 5814
  Gene Symbol: FAM171A2
  Gene Name: family with sequence similarity 171, member A2
  ENSP ID: ENSP00000466493

SEQ ID NO: 29751 - protein, 826 aa, Homo sapiens
  Payload ID: 5815
  Gene Symbol: FAM171B
  Gene Name: family with sequence similarity 171, member B
  Uniprot ID: Q6P995
  ENSP ID: ENSP00000304108
MARLCRRVPCTLLLGLAVVLLKARLVPAAARAELSRSDLSLIQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDRIPAWTFDMNTGAWVNHGRGMVKEHNNHLIWTYDAPHLGYWIAAPLPGTRGSGINEDSKDITAYHTVFLTAILGGTIVIVIGFFAVLLCYCRDKCGTPQKRERNITKLEVLKRDQTTSTTHINHISTVKVALKAEDKSQLFNAKNSSYSPQKKEPSKAETEERVSMVKTRDDFKIYNEDVSFLSVNQNNYSRNPTQSLEPNVGSKQPKHINNNLSSSLGDAQDEKRYLTGNEEAYGRSHIPEQLMHIYSQPIAILQTSDLFSTPEQLHTAKSATLPRKGQLVYGQLMEPVNRENFTQTLPKMPIHSHAQPPDAREEDIILEGQQSLPSQASDWSRYSSSLLESVSVPGTLNEAVVMTPFSSELQGISEQTLLELSKGKPSPHPRAWFVSLDGKPVAQVRHSFIDLKKGKRTQSNDTSLDSGVDMNELHSSRKLEREKTFIKSMHQPKILYLEDLDLSSSESGTTVCSPEDPALRHILDGGSGVIMEHPGEESPGRKSTVEDFEANTSPTKRRGRPPLAKRDSKTNIWKKREERPLIPIN

SEQ ID NO: 29752 - protein, 238 aa, Homo sapiens
  Payload ID: 5815
  Gene Symbol: FAM171B
  Gene Name: family with sequence similarity 171, member B
  ENSP ID: ENSP00000478477
MARLCRRVPCTLLLGLAVVLLKARLVPAAARAELSRSDLSLIQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITQ

SEQ ID NO: 29753 - protein, 416 aa, Homo sapiens
  Payload ID: 5816
  Gene Symbol: FAM172A
  Gene Name: family with sequence similarity 172, member A
  Uniprot ID: Q8WUF8
  ENSP ID: ENSP00000379294
MSISLSSLILLPIWINMAQIQQGGPDEKEKTTALKDLLSRIDLDELMKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 29754 - protein, 269 aa, Homo sapiens
  Payload ID: 5816
  Gene Symbol: FAM172A
  Gene Name: family with sequence similarity 172, member A
  ENSP ID: ENSP00000421834
MNRLLIFLIPWKDLNMLLMKIITKYVYELLEKDCNLKKVSIPEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 29755 - protein, 370 aa, Homo sapiens
  Payload ID: 5816
  Gene Symbol: FAM172A
  Gene Name: family with sequence similarity 172, member A
  Uniprot ID: Q8WUF8
  ENSP ID: ENSP00000423841
MKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 29756 - protein, 305 aa, Homo sapiens
  Payload ID: 5816
  Gene Symbol: FAM172A
  Gene Name: family with sequence similarity 172, member A
  ENSP ID: ENSP00000424097
MNRLLIFLIPWKDLNMLLMKIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGFSCCQMQSHEDLLLCFLL

SEQ ID NO: 29757 - protein, 306 aa, Homo sapiens
  Payload ID: 5816
  Gene Symbol: FAM172A
  Gene Name: family with sequence similarity 172, member A
  Uniprot ID: Q8WUF8
  ENSP ID: ENSP00000426284
MKKDEPPLDFPDTLEGFEYAFNEKGQLRHIKTGEPFVFNYREDLHRWNQKRYEALGEIITKYVYELLEKDCNLKKVSIPEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 29758 - protein, 218 aa, Homo sapiens
  Payload ID: 5817
  Gene Symbol: FAM173A
  Gene Name: family with sequence similarity 173, member A
  ENSP ID: ENSP00000219535
MEQDDPVEALTELRERRLGALELLQAAAGSGLAAYAVWALLLQPGFRRVPLRLQVPYVGASARQVEHVLSLLRGRPGKTVDLGSGDGRIVLAAHRCGLRPAVGYELNPWLVALARLHAWRAGCAGSVCYRRKDLWKLPLLEDKLRTELPAGARVVSGRFPLPTWQPVTAVGEGLDRVWAYDVPEGGQAGEAASSRIPIQAAPGPSSAPIPGGLISQAS

SEQ ID NO: 29759 - protein, 235 aa, Homo sapiens
  Payload ID: 5817
  Gene Symbol: FAM173A
  Gene Name: family with sequence similarity 173, member A
  Uniprot ID: Q9BQD7
  ENSP ID: ENSP00000454380
MEQDDPVEALTELRERRLGALELLQAAAGSGLAAYAVWALLLQPGFRRVPLRLQVPYVGASARQVEHVLSLLRGRPGKTVDLGSGDGRIVLAAHRCGLRPAVGYELNPWLVALARLHAWRAGCAGSVCYRRKDLWKVSLRDCRNVSVFLAPSVLPLLEDKLRTELPAGARVVSGRFPLPTWQPVTAVGEGLDRVWAYDVPEGGQAGEAASSRIPIQAAPGPSSAPIPGGLISQAS

SEQ ID NO: 29760 - protein, 174 aa, Homo sapiens
  Payload ID: 5817
  Gene Symbol: FAM173A
  Gene Name: family with sequence similarity 173, member A
  ENSP ID: ENSP00000455283
MEQDDPVEALTELRERRLGALELLQAAAGSGLAAYAVWALLLQPGFRRVPLRLQVPYVGASARQVEHVLSLLRGRPGKTVDLGSGDGRIVLAAHRCGLRPAVGYELNPWLVALARLHAWRAGCAGSVCYRRKDLWKVSLRDCRNVSVFLAPSVVGAGLPAPLGSPSHTPGCLLL

SEQ ID NO: 29761 - protein, 140 aa, Homo sapiens
  Payload ID: 5817
  Gene Symbol: FAM173A
  Gene Name: family with sequence similarity 173, member A
  ENSP ID: ENSP00000455962
  MOD_RES (1)..(1): Any amino acid
XVDLGSGDGRIVLAAHRCGLRPAVGYELNPWLVALARLHAWRAGCAGSVCYRRKDLWKLPLLEDKLRTELPAGARVVSGRFPLPTWQPVTAVGEGLDRVWAYDVPEGGQAGEAASSRIPIQAAPGPSSAPIPGGLISQAS

SEQ ID NO: 29762 - protein, 69 aa, Homo sapiens
  Payload ID: 5818
  Gene Symbol: FAM173B
  Gene Name: family with sequence similarity 173, member B
  ENSP ID: ENSP00000280330
MMLQLEKKLERELEDDARVIACRFPFPHWTPDHVTGEGIDTVWAYDASTFRGREKRPCTSMHFQLPIQA

SEQ ID NO: 29763 - protein, 216 aa, Homo sapiens
  Payload ID: 5818
  Gene Symbol: FAM173B
  Gene Name: family with sequence similarity 173, member B
  Uniprot ID: Q6P4H8
  ENSP ID: ENSP00000420876
MEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVIAAAKKGFTAVGYELNPWLVWYSRYRAWREGVHGSAKFYISDLWKMLQLEKKLERELEDDARVIACRFPFPHWTPDHVTGEGIDTVWAYDASTFRGREKRPCTSMHFQLPIQA

SEQ ID NO: 29764 - protein, 233 aa, Homo sapiens
  Payload ID: 5818
  Gene Symbol: FAM173B
  Gene Name: family with sequence similarity 173, member B
  Uniprot ID: Q6P4H8
  ENSP ID: ENSP00000422338
MEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVIAAAKKGFTAVGYELNPWLVWYSRYRAWREGVHGSAKFYISDLWKVTFSQYSNVVIFGVPQMMLQLEKKLERELEDDARVIACRFPFPHWTPDHVTGEGIDTVWAYDASTFRGREKRPCTSMHFQLPIQA

SEQ ID NO: 29765 - protein, 109 aa, Homo sapiens
  Payload ID: 5818
  Gene Symbol: FAM173B
  Gene Name: family with sequence similarity 173, member B
  ENSP ID: ENSP00000424210
MEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVSSAKTF

SEQ ID NO: 29766 - protein, 149 aa, Homo sapiens
  Payload ID: 5818
  Gene Symbol: FAM173B
  Gene Name: family with sequence similarity 173, member B
  ENSP ID: ENSP00000427453
MEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVIFIAYYYLFTKPSSQTLSFHCCCASPLMERCSGFSAMFCSTSPGVG

SEQ ID NO: 29767 - protein, 190 aa, Homo sapiens
  Payload ID: 5819
  Gene Symbol: FAM174A
  Gene Name: family with sequence similarity 174, member A
  Uniprot ID: Q8TBP5
  ENSP ID: ENSP00000307954
MKASQCCCCLSHLLASVLLLLLLPELSGPLAVLLQAAEAAPGLGPPDPRPRTLPPLPPGPTPAQQPGRGLAEAAGPRGSEGGNGSNPVAGLETDDHGGKAGEGSVGGGLAVSPNPGDKPMTQRALTVLMVVSGAVLVYFVVRTVRMRRRNRKTRRYGVLDTNIENMELTPLEQDDEDDDNTLFDANHPRR

SEQ ID NO: 29768 - protein, 159 aa, Homo sapiens
  Payload ID: 5820
  Gene Symbol: FAM174B
  Gene Name: family with sequence similarity 174, member B
  Uniprot ID: Q3ZCQ3
  ENSP ID: ENSP00000329040
MRAVPLPAPLLPLLLLALLAAPAARASRAESVSAPWPEPERESRPPPGPGPGNTTRFGSGAAGGSGSSSSNSSGDALVTRISILLRDLPTLKAAVIVAFAFTTLLIACLLLRVFRSGKRLKKTRKYDIITTPAERVEMAPLNEEDDEDEDSTVFDIKYR

SEQ ID NO: 29769 - protein, 113 aa, Homo sapiens
  Payload ID: 5820
  Gene Symbol: FAM174B
  Gene Name: family with sequence similarity 174, member B
  ENSP ID: ENSP00000452295
MKRMMKMRTPQYSTSNTGKTCFPAWWHPVESWSAATWGVKDWTWKPSCVGGVETKTNVMYKTPAPSCVSGICSDCHWQARFHVTTMELLLPPFGHPFKVPPTSTPHVRGFVPC

SEQ ID NO: 29770 - protein, 109 aa, Homo sapiens
  Payload ID: 5820
  Gene Symbol: FAM174B
  Gene Name: family with sequence similarity 174, member B
  ENSP ID: ENSP00000455213
MKRMMKMRTPQYSTSNTGKTCFPAWWHPVESWSAATWGVKDWTWKPSCVGGVETKTNVMYKTPAPSCVSGICSDCHWQARFHVTTMELLLPPFGHPFKVPPTSTPHVRG

SEQ ID NO: 29771 - protein, 91 aa, Homo sapiens
  Payload ID: 5820
  Gene Symbol: FAM174B
  Gene Name: family with sequence similarity 174, member B
  ENSP ID: ENSP00000455517
MKRMMKMRTPQYSTSNTGKTCFPAWWHPVESWSAATWGVKDWTWKPSCVGGVETKTNVMYKTPAPSCVSGICSDCHWQARFHVTTMELLLP

SEQ ID NO: 29772 - protein, 113 aa, Homo sapiens; identical to SEQ ID NO: 29769
  Payload ID: 5820
  Gene Symbol: FAM174B
  Gene Name: family with sequence similarity 174, member B
  ENSP ID: ENSP00000455765

SEQ ID NO: 29773 - protein, 67 aa, Homo sapiens
  Payload ID: 5820
  Gene Symbol: FAM174B
  Gene Name: family with sequence similarity 174, member B
  ENSP ID: ENSP00000456099
MMKMRTPQYSTSNTGKTCFPAWWHPVESWSAATWGVKDWTWKPSCVGGVETKTNVMYKTPAPSCVSG

SEQ ID NO: 29774 - protein, 113 aa, Homo sapiens; identical to SEQ ID NO: 29769
  Payload ID: 5820
  Gene Symbol: FAM174B
  Gene Name: family with sequence similarity 174, member B
  ENSP ID: ENSP00000456619

SEQ ID NO: 29775 - protein, 37 aa, Homo sapiens
  Payload ID: 5820
  Gene Symbol: FAM174B
  Gene Name: family with sequence similarity 174, member B
  ENSP ID: ENSP00000457201
MKRMMKMRTPQYSTSNTGLSGDSREPGHLAAVRPLNL

SEQ ID NO: 29776 - protein, 409 aa, Homo sapiens
  Payload ID: 5821
  Gene Symbol: FAM175A
  Gene Name: family with sequence similarity 175, member A
  Uniprot ID: Q6UWZ7
  ENSP ID: ENSP00000369857
MEGESTSAVLSGFVLGALAFQHLNTDSDTEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 29777 - protein, 82 aa, Homo sapiens
  Payload ID: 5821
  Gene Symbol: FAM175A
  Gene Name: family with sequence similarity 175, member A
  ENSP ID: ENSP00000421068
MMLKLFIQLMESHSVAQTGVKWHDLGSLQPLPLEVKRFSCLGLRSSWDYRHTQPCPANFFCIFSRDGVSPCWPGWSRTPDLK

SEQ ID NO: 29778 - protein, 37 aa, Homo sapiens
  Payload ID: 5821
  Gene Symbol: FAM175A
  Gene Name: family with sequence similarity 175, member A
  ENSP ID: ENSP00000421876
MEGESTSAVLSGFVLGALAFQHLNTDSDTVGRGGSRL

SEQ ID NO: 29779 - protein, 74 aa, Homo sapiens
  Payload ID: 5821
  Gene Symbol: FAM175A
  Gene Name: family with sequence similarity 175, member A
  ENSP ID: ENSP00000426080
MEGESTSAVLSGFVLGALAFQHLNTDSDTEGFLLGEVKGEAKNSITDSQMDDVEVVYTIDIQKYIPCYQLFRMW

SEQ ID NO: 29780 - protein, 360 aa, Homo sapiens
  Payload ID: 5821
  Gene Symbol: FAM175A
  Gene Name: family with sequence similarity 175, member A
  ENSP ID: ENSP00000426763
MDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 29781 - protein, 220 aa, Homo sapiens
  Payload ID: 5821
  Gene Symbol: FAM175A
  Gene Name: family with sequence similarity 175, member A
  ENSP ID: ENSP00000480277
MKTSSPKENCLFLCFTSMKNGQEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELK

SEQ ID NO: 29782 - protein, 189 aa, Homo sapiens
  Payload ID: 5821
  Gene Symbol: FAM175A
  Gene Name: family with sequence similarity 175, member A
  ENSP ID: ENSP00000481099
MEGESTSAVLSGFVLGALAFQHLNTDSDTVSRGTGRGPASPGKSPARGLPPRCCSGPRPLPRRRRASSLRSRLCLLSPSAVPEEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLL

SEQ ID NO: 29783 - protein, 198 aa, Homo sapiens
  Payload ID: 5821
  Gene Symbol: FAM175A
  Gene Name: family with sequence similarity 175, member A
  ENSP ID: ENSP00000482434
LLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKLYSFSECHLHPGSRLKEQPLFGTCPHGIRQRARKLVDYRREPPQLAHELIFQFISVYFQRTNWHDKSCINEKLHVKKHFTTYKAYL

SEQ ID NO: 29784 - protein, 415 aa, Homo sapiens
  Payload ID: 5822
  Gene Symbol: FAM175B
  Gene Name: family with sequence similarity 175, member B
  Uniprot ID: Q15018
  ENSP ID: ENSP00000298492
MAASISGYTFSAVCFHSANSNADHEGFLLGEVRQEETFSISDSQISNTEFLQVIEIHNHQPCSKLFSFYDYASKVNEESLDRILKDRRKKVIGWYRFRRNTQQQMSYREQVLHKQLTRILGVPDLVFLLFSFISTANNSTHALEYVLFRPNRRYNQRISLAIPNLGNTSQQEYKVSSVPNTSQSYAKVIKEHGTDFFDKDGVMKDIRAIYQVYNALQEKVQAVCADVEKSERVVESCQAEVNKLRRQITQRKNEKEQERRLQQAVLSRQMPSESLDPAFSPRMPSSGFAAEGRSTLGDAEASDPPPPYSDFHPNNQESTLSHSRMERSVFMPRPQAVGSSNYASTSAGLKYPGSGADLPPPQRAAGDSGEDSDDSDYENLIDPTEPSNSEYSHSKDSRPMAHPDEDPRNTQTSQI

SEQ ID NO: 29785 - protein, 236 aa, Homo sapiens
  Payload ID: 5823
  Gene Symbol: FAM177A1
  Gene Name: family with sequence similarity 177, member A1
  Uniprot ID: Q8N128
  ENSP ID: ENSP00000280987
MEVGLPAITLFLTSASSPVVATTMDQEPVGGVERGEAVAASGAAAAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 29786 - protein, 213 aa, Homo sapiens
  Payload ID: 5823
  Gene Symbol: FAM177A1
  Gene Name: family with sequence similarity 177, member A1
  Uniprot ID: Q8N128
  ENSP ID: ENSP00000371843
MDQEPVGGVERGEAVAASGAAAAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 29787 - protein, 213 aa, Homo sapiens; identical to SEQ ID NO: 29786
  Payload ID: 5823
  Gene Symbol: FAM177A1
  Gene Name: family with sequence similarity 177, member A1
  Uniprot ID: Q8N128
  ENSP ID: ENSP00000379734

SEQ ID NO: 29788 - protein, 7 aa, Homo sapiens
  Payload ID: 5823
  Gene Symbol: FAM177A1
  Gene Name: family with sequence similarity 177, member A1
  ENSP ID: ENSP00000450424
  MOD_RES (1)..(1): Any amino acid
XLRGPLF

SEQ ID NO: 29789 - protein, 36 aa, Homo sapiens
  Payload ID: 5823
  Gene Symbol: FAM177A1
  Gene Name: family with sequence similarity 177, member A1
  ENSP ID: ENSP00000451165
AAAAAFGESAGQVGGAAEADVRGAEPPPCLLRGPLF

SEQ ID NO: 29790 - protein, 75 aa, Homo sapiens
  Payload ID: 5823
  Gene Symbol: FAM177A1
  Gene Name: family with sequence similarity 177, member A1
  ENSP ID: ENSP00000451508
MDQEPVGGVERGEAVAASGAAAAAAFGESAGQMSNERGFENVELGVIGKKKKVPRRVIHFVSGETMEEYSTDEDE

SEQ ID NO: 29791 - protein, 140 aa, Homo sapiens
  Payload ID: 5823
  Gene Symbol: FAM177A1
  Gene Name: family with sequence similarity 177, member A1
  ENSP ID: ENSP00000452223
MSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDS

SEQ ID NO: 29792 - protein, 49 aa, Homo sapiens
  Payload ID: 5823
  Gene Symbol: FAM177A1
  Gene Name: family with sequence similarity 177, member A1
  ENSP ID: ENSP00000452425
  MOD_RES (1)..(1): Any amino acid
XNKLQTDSIVQTDQPETVISSSFVNVNFEMEGDSEVIMESKQNPVSVPP

SEQ ID NO: 29793 - protein, 39 aa, Homo sapiens
  Payload ID: 5823
  Gene Symbol: FAM177A1
  Gene Name: family with sequence similarity 177, member A1
  ENSP ID: ENSP00000473546
  MOD_RES (1)..(1): Any amino acid
XAFGESAGQEIKGSKKLSHGPKGNVDVRTAIAKFYLKDE

SEQ ID NO: 29794 - protein, 89 aa, Homo sapiens
  Payload ID: 5823
  Gene Symbol: FAM177A1
  Gene Name: family with sequence similarity 177, member A1
  ENSP ID: ENSP00000484619
MEVGLPAITLFLTSASSPVVATTMDQEPVGGVERGEAVAASGAAAAAAFGESAGQNLTLLPRLKFMARSRLAATSTSRVQAILLPQPPV

SEQ ID NO: 29795 - protein, 158 aa, Homo sapiens
  Payload ID: 5824
  Gene Symbol: FAM177B
  Gene Name: family with sequence similarity 177, member B
  Uniprot ID: A6PVY3
  ENSP ID: ENSP00000354070
MEIDGFQQLDLEKSVPSKKTTPKRIIHFVDGDIMEEYSTEEEEEEEKEEQSTNSTLDPSKLSWGPYLRFWAGRIASTSFSTCEFLGGRFAVFFGLTQPKYQYVLNEFYRIQNKKSDNKSERRGSKAQAAEVPNEKCHLEAGVQEYGTIQQDVTEAIPQ

SEQ ID NO: 29796 - protein, 120 aa, Homo sapiens
  Payload ID: 5824
  Gene Symbol: FAM177B
  Gene Name: family with sequence similarity 177, member B
  Uniprot ID: A6PVY3
  ENSP ID: ENSP00000375752
MEIDGFQQLDLEKSVPSKKTTPKRIIHFVDGDIMEEYSTEEEEEEEKEEQSTNSTLDPSKLSWGPYLRFWAGRIASTSFSMLSLQATLLLKAEKEGLKQLLRSLSGCMEEFLMWVLVTLD

SEQ ID NO: 29797 - protein, 100 aa, Homo sapiens
  Payload ID: 5824
  Gene Symbol: FAM177B
  Gene Name: family with sequence similarity 177, member B
  ENSP ID: ENSP00000391615
MEIDGFQQLDLEKSVPSKKTTPKRIIHFVDGDIMEEYSTEEEEEEEKEEQSTNSTLDPSKLSWGPYLRFWAGRIASTSFSTCEFLGGRFAVFFGLTQPKY

SEQ ID NO: 29798 - protein, 99 aa, Homo sapiens
  Payload ID: 5824
  Gene Symbol: FAM177B
  Gene Name: family with sequence similarity 177, member B
  ENSP ID: ENSP00000400233
MEIDGFQQLDLEKSVPSKKTTPKRIIHFVDGDIMEEYSTEEEEEEEKEEQSTNSTLDPSKLSWGPYLRFWAGRIASTSFSTCEFLGGRFAVFFGLTQPK

SEQ ID NO: 29799 - protein, 158 aa, Homo sapiens; identical to SEQ ID NO: 29795
  Payload ID: 5824
  Gene Symbol: FAM177B
  Gene Name: family with sequence similarity 177, member B
  Uniprot ID: A6PVY3
  ENSP ID: ENSP00000414451

SEQ ID NO: 29800 - protein, 119 aa, Homo sapiens
  Payload ID: 5825
  Gene Symbol: FAM178B
  Gene Name: family with sequence similarity 178, member B
  Uniprot ID: Q8IXR5
  ENSP ID: ENSP00000377160
MRPSSLRQYLDSVPLPPCQEQQPKASAELDHKACYLCHSLLMLAGVVVSCQDITPDQWGELQLLCMQLDRHISTQIRESPQAMHRTMLKDLATQTYIRWQELLTHCQPQAQYFSPWKDI

SEQ ID NO: 29801 - protein, 679 aa, Homo sapiens
  Payload ID: 5825
  Gene Symbol: FAM178B
  Gene Name: family with sequence similarity 178, member B
  Uniprot ID: Q8IXR5
  ENSP ID: ENSP00000429896
MWPRLPGAGLAPQLRRQDQRLHFTGQMSHGLQMAGPQETVLALPLREGVQAAATVPILLYNLEDGLSDHPLDQGPRCPARRPCSPASAPAPTSPKKPKIQAPGETFPTDWSPPPVEFLNPRVLQASREAPAQRWVGVVGPQGLRRLAGELPEELEQEHLDLDPKRGLALPEKLFWNTSGLSQQAAAPEFSWGGSGSYFNNLDYLLQEKREQALEQERERLLLQECLNLNSLDLDEEEVPLTPEHRMLVEKYSVSLQTIPPVHPGETVFLPRCHPLPCILDSSLLKPRSHLEGLFLSSPPAQQLSFLRSGLLNILYLHMPDCPVSLLQWLFQLLTWPPETSLGAFGLLWDLIVDGIFLQPDEDKHLWCPSLQEVREAFHSLGAHSPALYPLGPFWHGGRVLPGEAGLNENEEQDAPQEIALDISLGHIYKFLALCAQAQPGAYTDENLMGLIELLCRTSLDVGLRLLPKVDLQQLLLLLLENIREWPGKLQELCCTLSWVSDHHHNLLALVQFFPDMTSRSRRLRSQLSLVVIARMLGQQEMLPLWQEKTQLSSLSRLLGLMRPSSLRQYLDSVPLPPCQEQQPKASAELDHKACYLCHSLLMLAGVVVSCQDITPDQWGELQLLCMQLDRHISTQIRESPQAMHRTMLKDLATQTYIRWQELLTHCQPQAQYFSPWKDI

SEQ ID NO: 29802 - protein, 1019 aa, Homo sapiens
  Payload ID: 5826
  Gene Symbol: FAM179A
  Gene Name: family with sequence similarity 179, member A
  Uniprot ID: Q6ZUX3
  ENSP ID: ENSP00000368876
MGTRDDVPEAKVLVPVAVYCGSIPRTSAGPRVLPPGSINSSLPHGEGSLQPEPRALLNNEEPSQLLRGLGQLGGLKLDTPSKGWQARNGHPRNLRALSLGDQPLVLLPSPESEANSVARDTIQIKDKLKKRRLSEGLAASSRASLDPGGGPQGVPLHSTIPRATSQRLLRVPRPMPLIQSIPTTPEASGVKEKGLDLPGSIPGPHELRPGAQEAQISWQYLHCNDEKMQKSLGAIVIPPIPKARTVAATPSRVPGSLPSPLPPGQGVLTGLRAPRTRLARGSGPREKTPASLEPKPLASPIRDRPAAAKKPALPFSQSAPTLTAFSFDCAREACPPLKEEDQKEIGTKIQVTISKSAREKMQLKQMKEMELLRRLEEPRTGQELTSQCLGSQRAFMKEGLLPLRGSGTLSVPTRLSGPCRNDVSIILRKWASRASLPSIPISRQEPRFARHASANSLPAVLTLGSPEWEEEEEMDLRACKELRPFSNPELGLRDALQCLNSSDWQMKEKGLVSIQRLAACHSEVLTGKLHDVCLVVTGEVTNLRSKVSHLAISTLGDLFQALKKNMDQEAEEIARCLLQKMADTNEFIQRAAGQSLRAMVENVTLARSLVVLTSAGVYHRNPLIRKYAAEHLSAVLEQIGAEKLLSGTRDSTDMLVHNLVRLAQDSNQDTRFYGRKMVNILMANTKFDAFLKQSLPSYDLQKVMAAIKQQGIEDNDELPSAKGRKVLRSLVVCENGLPIKEGLSCNGPRLVGLRSTLQGRGEMVEQLRELTRLLEAKDFRSRMEGVGQLLELCKAKTELVTAHLVQVFDAFTPRLQDSNKKVNQWALESFAKMIPLLRESLHPMLLSIIITVADNLNSKNSGIYAAAVAVLDAMVESLDNLCLLPALAGRVRFLSGRAVLDVTDRLAVLVASVYPRKPQAVERHVLPILWHFLNTATRNGTLPGPSGNIRGVVCRLSRSLQEHMGSRLLDFAASQPKHVLKTLQELLDSESLGGSRKATDRGVAPDSKTTGSSYPFQLD

SEQ ID NO: 29803 - protein, 162 aa, Homo sapiens
  Payload ID: 5826
  Gene Symbol: FAM179A
  Gene Name: family with sequence similarity 179, member A
  ENSP ID: ENSP00000384897
MDQEAEEIARCLLQKMADTNEFIQRAAGQSLRAMVENVTLARSLVVLTSAGVYHRNPLIRKYAAEHLSAVLEQIGAEKLLSGTRDSTDMLVHNLVRLAQDSNQDTRFYGRKMVNILMANTKFDAFLKQSLPSYDLQKVMAAIKQQGIEDNDELPSAKGRKVL

SEQ ID NO: 29804 - protein, 112 aa, Homo sapiens
  Payload ID: 5826
  Gene Symbol: FAM179A
  Gene Name: family with sequence similarity 179, member A
  ENSP ID: ENSP00000396739
MKEKGLVSIQRLAACHSEVLTGKLHDVCLVVTGEVTNLRSKVSHLAISTLGDLFQALKKNMDQEAEEIARCLLQKMADTNEFIQRAAGQSLRAMVENVTLARSLVVLTSAGV

SEQ ID NO: 29805 - protein, 69 aa, Homo sapiens
  Payload ID: 5826
  Gene Symbol: FAM179A
  Gene Name: family with sequence similarity 179, member A
  ENSP ID: ENSP00000402415
MGTRDDVPEAKVLVPVAVYCGSIPRTSAGPRVLPPGSINSSLPHGEGSLQPEPRALLNNEEPSQLLRGL

SEQ ID NO: 29806 - protein, 1773 aa, Homo sapiens
  Payload ID: 5827
  Gene Symbol: FAM179B
  Gene Name: family with sequence similarity 179, member B
  ENSP ID: ENSP00000354917
MAAAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQSHLHIAVRRCTAQHLSDVLEFMEPERILSAAKDMAERILPAAAKFAQDSSQETRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 29807 - protein, 1720 aa, Homo sapiens
  Payload ID: 5827
  Gene Symbol: FAM179B
  Gene Name: family with sequence similarity 179, member B
  Uniprot ID: Q9Y4F4
  ENSP ID: ENSP00000355045
MAAAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEMHSSLRSLRNSAAKKRAKLSGSTSDLESPDSAMKLDLTMDSPSLSSSPNINSYSESGVYSQESLTSSLSTTPQGKRIMSDIFPTFGSKPCPTRLSSAKKKISHIAEQSPSAGSSSNPQQISSFDFTTTKALSEDSVVVVGKGVFGSLSSAPATCSQSVISSVENGDTFSIKQSIEPPSGIYGRSVQQNISSYLDVENEKDAKVSISKSTYNKMRQKRKEEKELFHNKDCEKKEKNSWERMRHTGTEKMASESETPTGAISQYKERMPSVTHSPEIMDLSELRPFSKPEIALTEALRLLADEDWEKKIEGLNFIRCLAAFHSEILNTKLHETNFAVVQEVKNLRSGVSRAAVVCLSDLFTYLKKSMDQELDTTVKVLLHKAGESNTFIREDVDKALRAMVNNVTPARAVVSLINGGQRYYGRKMLFFMMCHPNFEKMLEKYVPSKDLPYIKDSVRNLQQKGLGEIPLDTPSAKGRRSHTGSVGNTRSSSVSRDAFNSAERAVTEVREVTRKSVPRNSLESAEYLKLITGLLNAKDFRDRINGIKQLLSDTENNQDLVVGNIVKIFDAFKSRLHDSNSKVNLVALETMHKMIPLLRDHLSPIINMLIPAIVDNNLNSKNPGIYAAATNVVQALSQHVDNYLLLQPFCTKAQFLNGKAKQDMTEKLADIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 29808 - protein, 155 aa, Homo sapiens
  Payload ID: 5827
  Gene Symbol: FAM179B
  Gene Name: family with sequence similarity 179, member B
  ENSP ID: ENSP00000450465
SRLHDSNSKVNLVALETMHKMIPLLRDHLSPIINMLIPAIVDNNLNSKNPGIYAAATNVVQALSQHVDIVTELYQRKPHATEQKVLVVLWHLLGNMTNSGSLPGAGGNIRTATAKLSKALFAQMGQNLLNQAASQPPHIKKSLEELLDMTILNEL

SEQ ID NO: 29809 - protein, 160 aa, Homo sapiens
  Payload ID: 5827
  Gene Symbol: FAM179B
  Gene Name: family with sequence similarity 179, member B
  ENSP ID: ENSP00000451013
  MOD_RES (1)..(1): Any amino acid
XFSRKRVSRNLFQNSRDFNPDCLPLCAAGTTGTHQTNLSGKCAQLGFSQICGKTGSVGSDLQFLGTTSSHQEKGENSQEKPPVQLTPALVRSPSSRRGLNGTKPVPPIPRGISLLPDKADLSTVGHKKKEPDDIWKCEKDSLPIDLSELNFKDKDLDQEE

SEQ ID NO: 29810 - protein, 174 aa, Homo sapiens
  Payload ID: 5827
  Gene Symbol: FAM179B
  Gene Name: family with sequence similarity 179, member B
  ENSP ID: ENSP00000451141
MFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKS

SEQ ID NO: 29811 - protein, 995 aa, Homo sapiens
  Payload ID: 5827
  Gene Symbol: FAM179B
  Gene Name: family with sequence similarity 179, member B
  Uniprot ID: Q9Y4F4
  ENSP ID: ENSP00000451829
MAAAPSALLLLPPFPVLSTYRLQSRSRPSAPETDDSRVGGIMRGEKNYYFRGAAGDHGSCPTTTSPLASALLMPSEAVSSSWSESGGGLSGGDEEDTRLLQLLRTARDPSEAFQALQAALPRRGGRLGFPRRKEALYRALGRVLVEGGSDEKRLCLQLLSDVLRGQGEAGQLEEAFSLALLPQLVVSLREENPALRKDALQILHICLKRSPGEVLRTLIQQGLESTDARLRASTALLLPILLTTEDLLLGLDLTEVIISLARKLGDQETEEESETAFSALQQIGERLGQDRFQSYISRLPSALRRHYNRRLESQFGSQVPYYLELEASGFPEDPLPCAVTLSNSNLKFGIIPQELHSRLLDQEDYKNRTQAVEELKQVLGKFNPSSTPHSSLVGFISLLYNLLDDSNFKVVHGTLEVLHLLVIRLGEQVQQFLGPVIAASVKVLADNKLVIKQEYMKIFLKLMKEVGPQQVLCLLLEHLKHKHSRVREEVVNICICSLLTYPSEDFDLPKLSFDLAPALVDSKRRVRQAALEAFAVLASSMGSGKTSILFKAVDTVELQDNGDGVMNAVQARLARKTLPRLTEQGFVEYAVLMPSSAGGRSNHLAHGADTDWLLAGNRTQSAHCHCGDHVRDSMHIYGSYSPTICTRRVLSAGKGKNKLPWENEQPGIMGENQTSTSKDIEQFSTYDFIPSAKLKLSQGMPVNDDLCFSRKRVSRNLFQNSRDFNPDCLPLCAAGTTGTHQTNLSGKCAQLGFSQICGKTGSVGSDLQFLGTTSSHQEKVYASLNFGSKTQQTFGSQTECTSSNGQNPSPGAYILPSYPVSSPRTSPKHTSPLIISPKKSQDNSVNFSNSWPLKSFEGLSKPSPQKKLVSQKSSDPTGRNHGENSQEKPPVQLTPALVRSPSSRRGLNGTKPVPPIPRGISLLPDKADLSTVGHKKKEPDDIWKCEKDSLPIDLSELNFKDKDLDQEEVRHISNIWVKTLSNKTFFCKEKNFSYC

SEQ ID NO: 29812 - protein, 173 aa, Homo sapiens
  Payload ID: 5828
  Gene Symbol: FAM180A
  Gene Name: family with sequence similarity 180, member A
  Uniprot ID: Q6UWF9
  ENSP ID: ENSP00000342336
MHWKMLLLLLLYYNAEASMCHRWSRAVLFPAAHRPKRSSSLPLNPVLQTSLEEVELLYEFLLAELEISPDLQISIKDEELASLRKASDFRTVCNNVIPKSIPDIRRLSASLSSHPGILKKEDFERTVLTLAYTAYRTALSHGHQKDIWAQSLVSLFQALRHDLMRSSQPGVPP

SEQ ID NO: 29813 - protein, 173 aa, Homo sapiens; identical to SEQ ID NO: 29812
  Payload ID: 5828
  Gene Symbol: FAM180A
  Gene Name: family with sequence similarity 180, member A
  Uniprot ID: Q6UWF9
  ENSP ID: ENSP00000395467

SEQ ID NO: 29814 - protein, 173 aa, Homo sapiens; identical to SEQ ID NO: 29812
  Payload ID: 5828
  Gene Symbol: FAM180A
  Gene Name: family with sequence similarity 180, member A
  Uniprot ID: Q6UWF9
  ENSP ID: ENSP00000406553

SEQ ID NO: 29815 - protein, 201 aa, Homo sapiens
  Payload ID: 5829
  Gene Symbol: FAM180B
  Gene Name: family with sequence similarity 180, member B
  ENSP ID: ENSP00000443133
MREQRTAEQSETQRTWLSMAATLQFLVCLVVAICLLSGVTTTQPHAGQPMDSTSVGGGLQEPEAPEVMFELLWAGLELDVMGQLHIQDEELASTHPGRRLRLLLQHHVPSDLEGTEQWLQQLQDLRKGPPLSTWDFEHLLLTGLSCVYRLHAASEAEERGRWAQVFALLAQETLWDLCKGFCPQDRPPSLGSWASILDPFP

SEQ ID NO: 29816 - protein, 354 aa, Homo sapiens
  Payload ID: 5830
  Gene Symbol: FAM181A
  Gene Name: family with sequence similarity 181, member A
  Uniprot ID: Q8N9Y4
  ENSP ID: ENSP00000267594
MPLEERRSSGERNDAAPTNHRRPGEKRASTAKQVSSVPFLGAAGHQQSLPSSWKASCSGPLVMASDSDVKMLLNFVNLASSDIKAALDKSAPCRRSVDHRKYLQKQLKRFSQKYSRLPRGLPGRAAEPYLKRGSEDRPRRLLLDLGPDSSPGGGGGCKEKVLRNPYREECLAKEQLPQRQHPEAAQPGQVPMRKRQLPASFWEEPRPTHSYHVGLEGGLGPREGPPYEGKKNCKGLEPLGPETTLVSMSPRALAEKEPLKMPGVSLVGRVNAWSCCPFQYHGQPIYPGPLGALPQSPVPSLGLWRKSPAFPGELAHLCKDVDGLGQKVCRPVVLKPIPTKPAVPPPIFNVFGYL

SEQ ID NO: 29817 - protein, 292 aa, Homo sapiens
  Payload ID: 5830
  Gene Symbol: FAM181A
  Gene Name: family with sequence similarity 181, member A
  Uniprot ID: Q8N9Y4
  ENSP ID: ENSP00000451445
MASDSDVKMLLNFVNLASSDIKAALDKSAPCRRSVDHRKYLQKQLKRFSQKYSRLPRGLPGRAAEPYLKRGSEDRPRRLLLDLGPDSSPGGGGGCKEKVLRNPYREECLAKEQLPQRQHPEAAQPGQVPMRKRQLPASFWEEPRPTHSYHVGLEGGLGPREGPPYEGKKNCKGLEPLGPETTLVSMSPRALAEKEPLKMPGVSLVGRVNAWSCCPFQYHGQPIYPGPLGALPQSPVPSLGLWRKSPAFPGELAHLCKDVDGLGQKVCRPVVLKPIPTKPAVPPPIFNVFGYL

SEQ ID NO: 29818 - protein, 292 aa, Homo sapiens; identical to SEQ ID NO: 29817
  Payload ID: 5830
  Gene Symbol: FAM181A
  Gene Name: family with sequence similarity 181, member A
  Uniprot ID: Q8N9Y4
  ENSP ID: ENSP00000451678

SEQ ID NO: 29819 - protein, 292 aa, Homo sapiens; identical to SEQ ID NO: 29817
  Payload ID: 5830
  Gene Symbol: FAM181A
  Gene Name: family with sequence similarity 181, member A
  Uniprot ID: Q8N9Y4
  ENSP ID: ENSP00000451802

SEQ ID NO: 29820 - protein, 232 aa, Homo sapiens
  Payload ID: 5830
  Gene Symbol: FAM181A
  Gene Name: family with sequence similarity 181, member A
  ENSP ID: ENSP00000452393
MASDSDVKMLLNFVNLASSDIKAALDKSAPCRRSVDHRKYLQKQLKRFSQKYSRLPRGLPGRAAEPYLKRGSEDRPRRLLLDLGPDSSPGGGGGCKEKVLRNPYREECLAKEQLPQRQHPEAAQPGQVPMRKRQLPASFWEEPRPTHSYHVGLEGGLGPREGPPYEGKKNCKGLEPLGPETTLVSMSPRALAEKEPLKMPGVSLVGRVNAWSCCPFQYHGQPIYPGPLGALP

SEQ ID NO: 29821 - protein, 292 aa, Homo sapiens; identical to SEQ ID NO: 29817
  Payload ID: 5830
  Gene Symbol: FAM181A
  Gene Name: family with sequence similarity 181, member A
  Uniprot ID: Q8N9Y4
  ENSP ID: ENSP00000478207

SEQ ID NO: 29822 - protein, 292 aa, Homo sapiens; identical to SEQ ID NO: 29817
  Payload ID: 5830
  Gene Symbol: FAM181A
  Gene Name: family with sequence similarity 181, member A
  Uniprot ID: Q8N9Y4
  ENSP ID: ENSP00000478780

SEQ ID NO: 29823 - protein, 354 aa, Homo sapiens; identical to SEQ ID NO: 29816
  Payload ID: 5830
  Gene Symbol: FAM181A
  Gene Name: family with sequence similarity 181, member A
  Uniprot ID: Q8N9Y4
  ENSP ID: ENSP00000479410

SEQ ID NO: 29824 - protein, 232 aa, Homo sapiens; identical to SEQ ID NO: 29820
  Payload ID: 5830
  Gene Symbol: FAM181A
  Gene Name: family with sequence similarity 181, member A
  ENSP ID: ENSP00000486055

SEQ ID NO: 29825 - protein, 292 aa, Homo sapiens; identical to SEQ ID NO: 29817
  Payload ID: 5830
  Gene Symbol: FAM181A
  Gene Name: family with sequence similarity 181, member A
  Uniprot ID: Q8N9Y4
  ENSP ID: ENSP00000486422

SEQ ID NO: 29826 - protein, 426 aa, Homo sapiens
  Payload ID: 5831
  Gene Symbol: FAM181B
  Gene Name: family with sequence similarity 181, member B
  Uniprot ID: A6NEQ2
  ENSP ID: ENSP00000365295
MAVQAALLSTHPFVPFGFGGSPDGLGGAFGALDKGCCFEDDETGAPAGALLSGAEGGDVREATRDLLSFIDSASSNIKLALDKPGKSKRKVNHRKYLQKQIKRCSGLMGAAPPGPPSPSAADTPAKRPLAAPSAPTVAAPAHGKAAPRREASQAAAAASLQSRSLAALFDSLRHVPGGAEPAGGEVAAPAAGLGGAGTGGAGGDVAGPAGATAIPGARKVPLRARNLPPSFFTEPSRAGGGGCGPSGPDVSLGDLEKGAEAVEFFELLGPDYGAGTEAAVLLAAEPLDVFPAGASVLRGPPELEPGLFEPPPAVVGNLLYPEPWSVPGCSPTKKSPLTAPRGGLTLNEPLSPLYPAAADSPGGEDGRGHLASFAPFFPDCALPPPPPPHQVSYDYSAGYSRTAYSSLWRSDGVWEGAPGEEGAHRD

SEQ ID NO: 29827 - protein, 152 aa, Homo sapiens
  Payload ID: 5832
  Gene Symbol: FAM182B
  Gene Name: family with sequence similarity 182, member B
  Uniprot ID: Q5T319
  ENSP ID: ENSP00000365585
MQEMVRELWMWNVEEEEHEVGICTWGGQHCGCPAKSLPGPHPGGVSAPQSASQLMVKLLVWQKSVHKLRKVSATSSIAVYPCPGQSSGGAESPAPGPGLAGWSHLCGAALAEVQAAPVSQAAVSDASLGPEWSQEGCRPGLTSGQHGGRDGR

SEQ ID NO: 29828 - protein, 151 aa, Homo sapiens
  Payload ID: 5832
  Gene Symbol: FAM182B
  Gene Name: family with sequence similarity 182, member B
  ENSP ID: ENSP00000365586
LEMVRELWMWNVEEEEHEVGICTWGGQHCGCPAKSLPGPHPGGVSAPQSASQLMVKLLVWQKSVHKLRKVSATSSIAVYPCPGQSSGGAESPAPGPGLAGWSHLCGAALAEVQAAPVSQAAVSDASLGPEWSQEGCRPGLTSGQHGGRDGR

SEQ ID NO: 29829 - protein, 107 aa, Homo sapiens
  Payload ID: 5832
  Gene Symbol: FAM182B
  Gene Name: family with sequence similarity 182, member B
  ENSP ID: ENSP00000464534
MQVSFDFSCLEMVRELWMWNVEEEEHEVGICTWGGQHCGCPAKSLPGPHPGGVSAPQSASQLMVKLLVWQKSVHKLRKVSATSSIAVYPCPGQSSGGAESPAPGPGL

SEQ ID NO: 29830 - protein, 134 aa, Homo sapiens
  Payload ID: 5833
  Gene Symbol: FAM183A
  Gene Name: family with sequence similarity 183, member A
  Uniprot ID: A6NL82
  ENSP ID: ENSP00000334415
MAGHPKEKVIPDEVHQNQILRELYLKELRTQKLYTQYHVNPLRKIHTVTRKPMSWHDNLEEPADARFLNLIHHAAQGPRKKYPETQTENQEVGWDLEPLINPERHDRRLNHFRVCSDITLYKAKTWGLGDDHHK

SEQ ID NO: 29831 - protein, 58 aa, Homo sapiens
  Payload ID: 5833
  Gene Symbol: FAM183A
  Gene Name: family with sequence similarity 183, member A
  ENSP ID: ENSP00000387018
MAGHPKEKVIPDEVHQNQILRELYLKELRTQKLYTQYHVNPLRKSESSYSHQEAHVLA

SEQ ID NO: 29832 - protein, 106 aa, Homo sapiens
  Payload ID: 5833
  Gene Symbol: FAM183A
  Gene Name: family with sequence similarity 183, member A
  ENSP ID: ENSP00000387249
MKRRVKSGTHLMCSLEVHTVTRKPMSWHDNLEEPADARFLNLIHHAAQGPRKKYPETQTENQEVGWDLEPLINPERHDRRLNHFRVCSDITLYKAKTWGLGDDHHK

SEQ ID NO: 29833 - protein, 139 aa, Homo sapiens
  Payload ID: 5833
  Gene Symbol: FAM183A
  Gene Name: family with sequence similarity 183, member A
  ENSP ID: ENSP00000387254
MAGHPKEKVIPDEVHQNQILRELYLKELRTQKLYTQYHVNPLRKIHTVTRKPMSWHDNLEEPADARFLNLIHHAAQGPRKKYPETQTENQEVGWDLEPLVSVAPSSGNTRKHSSNINPERHDRRLNHFRVCSDITLYKA

SEQ ID NO: 29834 - protein, 971 aa, Homo sapiens
  Payload ID: 5834
  Gene Symbol: FAM184A
  Gene Name: family with sequence similarity 184, member A
  Uniprot ID: Q8NB25
  ENSP ID: ENSP00000326608
MKQQALTEFEAYKHRVEDMQLCAEAQHVQRIVTMSREVEEIRRKFEEKLRSFGQLQVQFEKDKRLALEDLQAAHRREIQELLKSQQDHSASVNKGQEKAEELHRMEVESLNKMLEELRLERKKLIEDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLEEMEEKYLMRESKPEDIQMITELKAMLTERDQIIKKLIEDNKFYQLELVNRETNFNKVFNSSPTVGVINPLAKQKKKNDKSPTNRFVSVPNLSALESGGVGNGHPNRLDPIPNSPVHDIEFNSSKPLPQPVPPKGPKTFLSPAQSEASPVASPDPQRQEWFARYFTF

SEQ ID NO: 29835 - protein, 1140 aa, Homo sapiens
  Payload ID: 5834
  Gene Symbol: FAM184A
  Gene Name: family with sequence similarity 184, member A
  Uniprot ID: Q8NB25
  ENSP ID: ENSP00000342604
MATPGMSWQQHYYGGSAAKFAPSPATAQLAGHSMDYSQEMHLKMSKKIAQLTKVIYALNTKNDEHESAIQALKDAHEEEIQQILAETREKILQYKSKVTEELDLRRKIQVLESSLEDHIKMKQQALTEFEAYKHRVEDMQLCAEAQHVQRIVTMSREVEEIRRKFEEKLRSFGQLQVQFEKDKRLALEDLQAAHRREIQELLKSQQDHSASVNKGQEKAEELHRMEVESLNKMLEELRLERKKLIEDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLHEQDLNKRLEKELDVMTADHLREKNIMRADFNKTNELLKEINAALQVSLEEMEEKYLMRESKPEDIQMITELKAMLTERDQIIKKLIEDNKFYQLELVNRETNFNKVFNSSPTVGVINPLAKQKKKNDKSPTNRFVSVPNLSALESGGVGNGHPNRLDPIPNSPVHDIEFNSSKPLPQPVPPKGPKTFLSPAQSEASPVASPDPQRQEWFARYFTF

SEQ ID NO: 29836 - protein, 165 aa, Homo sapiens
  Payload ID: 5834
  Gene Symbol: FAM184A
  Gene Name: family with sequence similarity 184, member A
  ENSP ID: ENSP00000357457
MTADHLREKNIMRADFNKTNELLKEINAALQVSLEEMEEKYLMRESKPEDIQMITELKAMLTERDQIIKKLIEDNKFYQLELVNRETNFNKVFNSSPTVGVINPLAKVSVRCMCMSSRNMTTGVSITHCCVPCNFPQRRPAQSEASPVASPDPQRQEWFARYFTF

SEQ ID NO: 29837 - protein, 936 aa, Homo sapiens
  Payload ID: 5834
  Gene Symbol: FAM184A
  Gene Name: family with sequence similarity 184, member A
  ENSP ID: ENSP00000357460
MKQQALTEFEAYKHRVEDMQLCAEAQHVQRIVTMSREVEEIRRKFEEKLRSFGQLQVQFEKDKRLALEDLQAAHRREIQELLKSQQDHSASVNKGQEKAEELHRMEVESLNKMLEELRLERKKLIEDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLEEMEEKYLMRESKPEDIQMITELKAMLTERDQIIKKLIQKKKNDKSPTNRFVSVPNLSALESGGVGNGHPNRLDPIPNSPVHDIEFNSSKPLPQPVPPKGPKTFLSPAQSEASPVASPDPQRQEWFARYFTF

SEQ ID NO: 29838 - protein, 141 aa, Homo sapiens
  Payload ID: 5834
  Gene Symbol: FAM184A
  Gene Name: family with sequence similarity 184, member A
  ENSP ID: ENSP00000403472
  MOD_RES (1)..(1): Any amino acid
XQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEARIL

SEQ ID NO: 29839 - protein, 371 aa, Homo sapiens
  Payload ID: 5834
  Gene Symbol: FAM184A
  Gene Name: family with sequence similarity 184, member A
  ENSP ID: ENSP00000429080
  MOD_RES (1)..(1): Any amino acid
XLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLHEQDLNKRLEKELDVMTADHLREKNIMRADFNKTNELLKEINAALQVSLEEMEEKYLMRESKPEDIQMITELKAMLTERDQIIKKLIEDNKFYQLELVNRETNFNKVFNSSPTVGVINPLAKQKKKNDKSPTNRFVSVPNLSALESGGVGNGHPNRLDPIPNSPVHDIEFNSSKPLPQPVPPKGPKTFLRYQ

SEQ ID NO: 29840 - protein, 268 aa, Homo sapiens
  Payload ID: 5834
  Gene Symbol: FAM184A
  Gene Name: family with sequence similarity 184, member A
  ENSP ID: ENSP00000429151
HNHHQELAAAKMELERSIDISRRQSKEHICRITDLQEELRHREHHISELDKEVQHLHENISALTKELEFKGKEILRIRSESNQQIRLHEQDLNKRLEKELDVMTADHLREKNIMRADFNKTNELLKEINAALQVSLEEMEEKYLMRESKPEDIQMITELKAMLTERDQIIKKLIQKKKNDKSPTNRFVSVPNLSALESGGVGNGHPNRLDPIPNSPVHDIEFNSSKPLPQPVPPKGPKTFLSPAQSEASPVASPDPQRQEWFARYFTF

SEQ ID NO: 29841 - protein, 74 aa, Homo sapiens
  Payload ID: 5834
  Gene Symbol: FAM184A
  Gene Name: family with sequence similarity 184, member A
  ENSP ID: ENSP00000429306
  MOD_RES (1)..(1): Any amino acid
XNRETNFNKVFNSSPTVGVINPLAKGLSSHVLFLMQQKKKNDKSPTNSPAQSEASPVASPDPQRQEWFARYFTF

SEQ ID NO: 29842 - protein, 529 aa, Homo sapiens
  Payload ID: 5834
  Gene Symbol: FAM184A
  Gene Name: family with sequence similarity 184, member A
  ENSP ID: ENSP00000429826
MKQQALTEFEAYKHRVEDMQLCAEAQHVQRIVTMSREVEEIRRKFEEKLRSFGQLQVQFEKDKRLALEDLQAAHRREIQELLKSQQDHSASVNKGQEKAEELHRMEVESLNKMLEELRLERKKLIEDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVELLVAPGILGIRQHNFHLCLSSHLKRIPGILEQGLILLQFDIILT

SEQ ID NO: 29843 - protein, 1056 aa, Homo sapiens
  Payload ID: 5834
  Gene Symbol: FAM184A
  Gene Name: family with sequence similarity 184, member A
  Uniprot ID: Q8NB25
  ENSP ID: ENSP00000430442
MATPGMSWQQHYYGGSAAKFAPSPATAQLAGHSMDYSQEMHLKMSKKIAQLTKVIYALNTKNDEHESAIQALKDAHEEEIQQILAETREKILQYKSKVTEELDLRRKIQVLESSLEDHIKMKQQALTEFEAYKHRVEDMQLCAEAQHVQRIVTMSREVEEIRRKFEEKLRSFGQLQVQFEKDKRLALEDLQAAHRREIQELLKSQQDHSASVNKGQEKAEELHRMEVESLNKMLEELRLERKKLIEDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLEEMEEKYLMRESKPEDIQMITELKAMLTERDQIIKKLIQKKKNDKSPTNRFVSVPNLSALESGGVGNGHPNRLDPIPNSPVHDIEFNSSKPLPQPVPPKGPKTFLSPAQSEASPVASPDPQRQEWFARYFTF

SEQ ID NO: 29844 - protein, 70 aa, Homo sapiens
  Payload ID: 5834
  Gene Symbol: FAM184A
  Gene Name: family with sequence similarity 184, member A
  ENSP ID: ENSP00000430643
  MOD_RES (1)..(1): Any amino acid
XFYQLELVNRETNFNKVFNSSPTVGVINPLAKQKKKNDKSPTNSPAQSEASPVASPDPQRQEWFARYFTF

SEQ ID NO: 29845 - protein, 268 aa, Homo sapiens
  Payload ID: 5834
  Gene Symbol: FAM184A
  Gene Name: family with sequence similarity 184, member A
  ENSP ID: ENSP00000484054
MELERSIDISRRQSKEHICRITDLQEELRHREHHISELDKEVQHLHENISALTKELEFKGKEILRIRSESNQQIRLHEQDLNKRLEKELDVMTADHLREKNIMRADFNKTNELLKEINAALQVSLEEMEEKYLMRESKPEDIQMITELKAMLTERDQIIKKLIEDNKFYQLELVNRETNFNKVFNSSPTVGVINPLAKQKKKNDKSPTNRFVSVPNLSALESGGVGNGHPNRLDPIPNSPVHDIEFNSSKPLPQPVPPKGPKTFLRYQ

SEQ ID NO: 29846 - protein, 1098 aa, Homo sapiens
  Payload ID: 5834
  Gene Symbol: FAM184A
  Gene Name: family with sequence similarity 184, member A
  ENSP ID: ENSP00000484827
MSKKIAQLTKVIYALNTKNDEHESAIQALKDAHEEEIQQILAETREKILQYKSKVTEELDLRRKIQVLESSLEDHIKMKQQALTEFEAYKHRVEDMQLCAEAQHVQRIVTMSREVEEIRRKFEEKLRSFGQLQVQFEKDKRLALEDLQAAHRREIQELLKSQQDHSASVNKGQEKAEELHRMEVESLNKMLEELRLERKKLIEDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLVNLQKKEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEEQHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLHEQDLNKRLEKELDVMTADHLREKNIMRADFNKTNELLKEINAALQVSLEEMEEKYLMRESKPEDIQMITELKAMLTERDQIIKKLIEDNKFYQLELVNRETNFNKVFNSSPTVGVINPLAKQKKKNDKSPTNRFVSVPNLSALESGGVGNGHPNRLDPIPNSPVHDIEFNSSKPLPQPVPPKGPKTFLSPAQSEASPVASPDPQRQEWFARYFTF

SEQ ID NO: 29847 - protein, 1060 aa, Homo sapiens
  Payload ID: 5835
  Gene Symbol: FAM184B
  Gene Name: family with sequence similarity 184, member B
  Uniprot ID: Q9ULE4
  ENSP ID: ENSP00000265018
MASALNSKINPPGTCQGSKADGGAGWRMDCDPQMHVKMCKKIAQLTKVIYALNTRQDEAEASMEALREAHQEELQNAVAETKARLLQEQGCAEEEALLQRIQALESALELQKRLTEEALAESASCRLETKERELRVEAEHAERVLTLSREMLELKADYERRLQHLTSHEATPQGRLPQESPETKSEPGQGPEMQEVLLEVQRLRVENQQLSKDYARKAEELQATYERENEAIRQAMQQSVSQALWQWQEKESDLRKNFQVQESALQAQVRKLEGDLEHRGRKISDLKKYAQKLKERIQDLDVQLKEARQENSELKGTAKKLGEKLAVAKDRMMLQECRGTQQTDAMKTELVSENKVLREENDLEAGNLHPQQDQSCLKECPCMKGGTDMQTKKEASAETEYMKQQYEEDLRKIKHQTEEEKKHLKDQLVKRLEDLVKKHTVEIKSVRSSVEAERKKLQREVEAQLEEVRKKSEKEIKQLEEEKAALNVKLQNSLLEVLRLEEFIQQNKTRPTGAEESPQELGRQHCSILETQDPCLKLDETSPRGEEYQDKLAAEEGTSSDEEERTKVLLKEGSDPQPPLGSLLKEKTSKIQRLEEDWQSQKAKLQAQVSQMQQALEQCTSNYREDLQALKQLSDLEREKLQRELQETTQQNHAMKAQLEASHQRALRMLEKARHQELKATEERLKKESSHSLQIQHQTHRLELQALEEKARQELQEERERMQAQQALLLESLRQELSEQQAACSGHQKDLEALQAELRALGRQQASSQCPGDSKDHIIATEERGGPGQAGSPPGAAGQGSGEGCGLWEENAQLQDAVRRLRAEVEQHQQEAQKLRDQRRFLEETQQAQRAREVETLRQEHRKEMQAMVADFSSAQAQLQARLAALEAELKDSGEKPGKGASRPEDLQLIGRLQTRLKEREDIIKQLTEERRFHYAAFPSAMSHRNRSFSFNPHPGYLTPSMKKKKVEDVPSRVVSVPNLASYAKNFLSGDLSSRINAPPITTSPSLDPSPSCGRTYKPNQSTDAKTATRTPDGETAQAKEVQQKQGSPHQEWFTKYFSF

SEQ ID NO: 29848 - protein, 275 aa, Homo sapiens
  Payload ID: 5836
  Gene Symbol: FAM185A
  Gene Name: family with sequence similarity 185, member A
  Uniprot ID: Q8N0U4
  ENSP ID: ENSP00000387066
MLAPCSGWELGCFRLCLRQVRLWAGAGRWACWACQARPYSSGGSERWPGSETEVPPPGPGRRTLKEWTLQGQKLHVQTKGGKVICLGTVYGNIDIHASDKSAVTIDKLQGSSVTVSTEDGLLKAKYLYTESSFLSSAAGDITLGSVHGNITLQSKMGNITVDSSSGCLKASTNQGAIDVYVSQLGKVELKSHKGSIIVKVPSSLQAHLQLSGKEVDVNSEVHVQEMAEVRKDDVVTVTGLMNQASKREKWIKADAPKGTVSFRRQSWFQSLKLQD

SEQ ID NO: 29849 - protein, 392 aa, Homo sapiens
  Payload ID: 5836
  Gene Symbol: FAM185A
  Gene Name: family with sequence similarity 185, member A
  Uniprot ID: Q8N0U4
  ENSP ID: ENSP00000395340
MLAPCSGWELGCFRLCLRQVRLWAGAGRWACWACQARPYSSGGSERWPGSETEVPPPGPGRRTLKEWTLQVSPFGRLRARLPCHLAVRPLDPLTYPDGDRVLVAVCGVEGGVRGLDGLQVKYDEDLEEMAIVSDTIHPQASVEVNAPLKFGLDIKSSGSGCVKVQSIEGDNCKIETEHGTSILQSVKGQKLHVQTKGGKVICLGTVYGNIDIHASDKSAVTIDKLQGSSVTVSTEDGLLKAKYLYTESSFLSSAAGDITLGSVHGNITLQSKMGNITVDSSSGCLKASTNQGAIDVYVSQLGKVELKSHKGSIIVKVPSSLQAHLQLSGKEVDVNSEVHVQEMAEVRKDDVVTVTGLMNQASKREKWIKADAPKGTVSFRRQSWFQSLKLQD

SEQ ID NO: 29850 - protein, 71 aa, Homo sapiens
  Payload ID: 5836
  Gene Symbol: FAM185A
  Gene Name: family with sequence similarity 185, member A
  ENSP ID: ENSP00000400947
MLAPCSGWELGCFRLCLRQVRLWAGAGRWACWACQARPYSSGGSERWPGSETEVPPPGPGRRTLKEWTLQV

SEQ ID NO: 29851 - protein, 194 aa, Homo sapiens
  Payload ID: 5836
  Gene Symbol: FAM185A
  Gene Name: family with sequence similarity 185, member A
  ENSP ID: ENSP00000410034
MLAPCSGWELGCFRLCLRQVRLWAGAGRWACWACQARPYSSGGSERWPGSETEVPPPGPGRRTLKEWTLQVSPFGRLRARLPCHLAVRPLDPLTYPDGDRVLVAVCGVEGGVRGLDGLQVKYDEDLEEMAIVSDTIHPQASVEVNAPLKFGLDIKSSGSGCVKVQSIEGDNCKIETEHGTSILQSVKGQKLHVQ

SEQ ID NO: 29852 - protein, 144 aa, Homo sapiens
  Payload ID: 5836
  Gene Symbol: FAM185A
  Gene Name: family with sequence similarity 185, member A
  Uniprot ID: Q8N0U4
  ENSP ID: ENSP00000410226
MLAPCSGWELGCFRLCLRQVRLWAGAGRWACWACQARPYSSGGSERWPGSETEVPPPGPGRRTLKEWTLQVSPFGRLRARLPCHLAVRPLDPLTYPDGDRVLVAVCGVEGGVRGLDGLQVKYDEDLEEMAIVSDTIHPQASVEV

SEQ ID NO: 29853 - protein, 2351 aa, Homo sapiens
  Payload ID: 5837
  Gene Symbol: FAM186A
  Gene Name: family with sequence similarity 186, member A
  Uniprot ID: A6NE01
  ENSP ID: ENSP00000329995
MFFKMKNEIDNDPESEKCIKDSTIMRREPQNILSPLMLPNLEIPFSVKDIISRIERAQLHRAREDIDMQLSEIMNNVHRIMTRYTLVFNSSSERNVSLTEHKKKQRTNFLEKMATYAKTIEIREKTLANILAWLEEWNDVLSEMTLMDVDEHHHWIAQMELLPDTLKAIENNVKILSRFSTSFLDEKKKQKKKILSRGTLWKSWKERVIKRPSTARALRPDQMISDQLATNTKVSEIQGMLQELIGTTMFSTLENNAIKYISSTIVNLSTALSMLNDELKCVNFQSSTVYAHETSEAEKELSLKIIRDLSNENEMLQQKLQDAEEKCEQLIRSKIVIEQLYAKLSTSSTLKVLPGPSPQSSRAIIKVGDTEDNMDNILDKELENIVDEVQRKETKDSGIKWDSTISYTAQAERTPDLTELRQQPVASEDISEDSTKDNVSLKKGDFYQEDETDEYQSWKRSHKKATYVYETSGPNLSDNKSGQKVSEAKPSQYYELQVLKKKRKEMKSFSEDKSKSPTEAKRKHLSLTETKSQGGKSGTSMMMLEQFRKVKRESPFDKRPTAAEIKVEPTTESLDKEGKGEIRSLVEPLSMIQFDDTAEPQKGKIKGKKHHISSGTITSKEEKTEEKEELTKQVKSHQLVKSLSRVAKETSESTRVLESPDGKSEQSNLEEFQEAIMAFLKQKIDNIGKAFDKKTVPKEEELLKRAEAEKLGIIKAKMEEYFQKVAETVTKILRKYKDTKKEEQVGEKPIKQKKVVSFMPGLHFQKSPISAKSESSTLLSYESTDPVINNLIQMILAEIESERDIPTVSTVQKDHKEKEKQRQEQYLQEGQEQMSGMSLKQQLLGERNLLKEHYEKISENWEEKKAWLQMKEGKQEQQSQKQWQEEEMWKEEQKQATPKQAEQEEKQKQRGQEEEELPKSSLQRLEEGTQKMKTQGLLLEKENGQMRQIQKEAKHLGPHRRREKGKEKQKPERGLEDLERQIKTKDQMQMKETQPKELEKMVIQTPMTLSPRWKSVLKDVQRSYEGKEFQRNLKTLENLPDEKEPISITPPPSLQYSLPGALPISGQPLTKCIHLTPQQAQEVGITLTPQQAQAQGITLTLQQAQELGIPLTPQQAQALEILFTPQQAQALGIPLTPQQTQVQGITLTPQQDQAPGISLTTQQAQKLGIPLTPQQAQALGIPLTPQQAQELGIPLTPQQAQALRVSLTPQQAQELGIPLTPQQAQALGITLTLQQAQQLGIPLTPQQAQALGITLTPKQVQELGIPLTPQQAQALGITLTPKQAQELGIPLNPQQAQTLGIPLTPKQAQALGIPFTPQQAQALGIPLTPQQAQTQEITLTPQQAQALGMPLTTQQAQELGIPLTPQHAQALGMPLTTQQAQELGIPLTPQQAQALGMPLTTQQAQELGIPLTPQQAQELGIPFTPQQAQAQEITLTPQQAQALGMPLTAQQAQELGITLTPQQAQELGIPLTPQQAQALGIPLIPPQAQELGIPLTPQQAQALGILLIPPQAQELGIPLTPQQAQALGIPLIPPQAQELGIPLTPQQVQALGIPLIPPQAQELEIPLTPQQAQALGIPLTPQQAQELGIPLTPQQAQELGIPLTPQQAQAQGIPLTPQQAQALGISLTPQQAQAQGITLTPQQAQALGVPITPVNAWVSAVTLTSEQTHALESPMNLEQAQEQLLKLGVPLTLDKAHTLGSPLTLKQVQWSHRPFQKSKASLPTGQSIISRLSPSLRLSLASSAPTAEKSSIFGVSSTPLQISRVPLNQGPFAPGKPLEMGILSEPGKLGAPQTLRSSGQTLVYGGQSTSAQFPAPQAPPSPGQLPISRAPPTPGQPFIAGVPPTSGQIPSLWAPLSPGQPLVPEASSIPGDLLESGPLTFSEQLQEFQPPATAEQSPYLQAPSTPGQHLATWTLPGRASSLWIPPTSRHPPTLWPSPAPGKPQKSWSPSVAKKRLAIISSLKSKSVLIHPSAPDFKVAQVPFTTKKFQMSEVSDTSEETQILRDTFAIESFRTFQSHFTKYRTPVYQTPYTDERALLTLMKPTTSPSSLTTLLRTSQISPLEWYQKSRFPPIDKPWILSSVSDTKKPKVMVPPSSPQELEEKRYFVDVEAQKKNLILLNQAIKTCGLPSQLHTMARTLIIEILHMDTVQLGYLFRKYIAYRLIQHARNNIMKRLKAIQNTGKGYEARNLHMMLSRLDDYGKKVMQVWTEKQKSLGQKRNQCLKKMIHVFNQLKKIHELNLSQPIPLIIEEKQIPASTTFVQKPFLKLLMEEDRTSDICKKFRQQEDQTEAIWNVDLSTSSYPIAEKTSMHSLWAQLGGYPDIPRLLQLEVQSTFRKSLASLQSRVKKIPK

SEQ ID NO: 29854 - protein, 73 aa, Homo sapiens
  Payload ID: 5837
  Gene Symbol: FAM186A
  Gene Name: family with sequence similarity 186, member A
  ENSP ID: ENSP00000437706
  MOD_RES (1)..(1): Any amino acid
XNNIMKRLKAIQNTGKGYEARNLHMMLSRLDDYGKKVMQVWTEKQKSLGQKRNQCLKKMIHATRGPDRGHLEC

SEQ ID NO: 29855 - protein, 2348 aa, Homo sapiens
  Payload ID: 5837
  Gene Symbol: FAM186A
  Gene Name: family with sequence similarity 186, member A
  ENSP ID: ENSP00000441337
MFFKMKNEIDNDPESEKCIKDSTIMRREPQNILSPLMLPNLEIPFSVKDIISRIERAQLHRAREDIDMQLSEIMNNVHRIMTRYTLVFNSSSERNVSLTEHKKKQRTNFLEKMATYAKTIEIREKTLANILAWLEEWNDVLSEMTLMDVDEHHHWIAQMELLPDTLKAIENNVKILSRFSTSFLDEKKKQKKKILSRGTLWKSWKERVIKRPSTARALRPDQMISDQLATNTKVSEIQGMLQELIGTTMFSTLENNAIKYISSTIVNLSTALSMLNDELKCVNFQSSTVYAHETSEAEKELSLKIIRDLSNENEMLQQKLQDAEEKCEQLIRSKIVIEQLYAKLSTSSTLKVLPGPSPQSSRAIIKVGDTEDNMDNILDKELENIVDEVQRKETKDSGIKWDSTISYTAQAERTPDLTELRQQPVASEDISEDSTKDNVSLKKGDFYQEDETDEYQSWKRSHKKATYVYETSGPNLSDNKSGQKVSEAKPSQYYELQVLKKKRKEMKSFSEDKSKSPTEAKRKHLSLTETKSQGGKSGTSMMMLEQFRKVKRESPFDKRPTAAEIKVEPTTESLDKEGKGEIRSLVEPLSMIQFDDTAEPQKGKIKGKKHHISSGTITSKEEKTEEKEELTKQVKSHQLVKSLSRVAKETSESTRVLESPDGKSEQSNLEEFQEAIMAFLKQKIDNIGKAFDKKTVPKEEELLKRAEAEKLGIIKAKMEEYFQKVAETVTKILRKYKDTKKEEQVGEKPIKQKKVVSFMPGLHFQKSPISAKSESSTLLSYESTDPVINNLIQMILAEIESERDIPTVSTVQKDHKEKEKQRQEQYLQEGQEQMSGMSLKQQLLGERNLLKEHYEKISENWEEKKAWLQMKEGKQEQQSQKQWQEEEMWKEEQKQATPKQAEQEEKQKQRGQEEEELPKSSLQRLEEGTQKMKTQGLLLEKENGQMRQIQKEAKHLGPHRRREKGKEKQKPERGLEDLERQIKTKDQMQMKETQPKELEKMVIQTPMTLSPRWKSVLKDVQRSYEGKEFQRNLKTLENLPDEKEPISITPPPSLQYSLPGALPISGQPLTKCIHLTPQQAQEVGITLTPQQAQAQGITLTLQQAQELGIPLTPQQAQALEILFTPQQAQALGIPLTPQQTQVQGITLTPQQDQAPGISLTTQQAQKLGIPLTPQQAQALGIPLTPQQAQELGIPLTPQQAQALRVSLTPQQAQELGIPLTPQQAQALGITLTLQQAQQLGIPLTPQQAQALGITLTPKQVQELGIPLTPQQAQALGITLTPKQAQELGIPLNPQQAQTLGIPLTPKQAQALGIPFTPQQAQALGIPLTPQQAQTQEITLTPQQAQALGMPLTTQQAQELGIPLTPQHAQALGMPLTTQQAQELGIPLTPQQAQALGMPLTTQQAQELGIPLTPQQAQELGIPFTPQQAQAQEITLTPQQAQALGMPLTAQQAQELGITLTPQQAQELGIPLTPQQAQALGIPLIPPQAQELGIPLTPQQAQALGILLIPPQAQELGIPLTPQQAQALGIPLIPPQAQELGIPLTPQQVQALGIPLIPPQAQELEIPLTPQQAQALGIPLTPQQAQELGIPLTPQQAQELGIPLTPQQAQAQGIPLTPQQAQALGISLTPQQAQAQGITLTPQQAQALGVPITPVNAWVSAVTLTSEQTHALESPMNLEQAQEQLLKLGVPLTLDKAHTLGSPLTLKQVQWSHRPFQKSKASLPTGQSIISRLSPSLRLSLASSAPTAEKSSIFGVSSTPLQISRVPLNQGPFAPGKPLEMGILSEPGKLGAPQTLRSSGQTLVYGGQSTSAQFPAPQAPPSPGQLPISRAPPTPGQPFIAGVPPTSGQIPSLWAPLSPGQPLVPEASSIPGDLLESGPLTFSEQLQEFQPPATAEQSPYLQAPSTPGQHLATWTLPGRASSLWIPPTSRHPPTLWPSPAPGKPQKSWSPSVAKKRLAIISSLKSKSVLIHPSAPDFKVAQVPFTTKKFQMSEVSDTSEETQILRDTFAIESFRTFQSHFTKYRTPVYQTPYTDERALLTLMKPTTSPSSLTTLLRTSQISPLEWYQKSRFPPIDKPWILSSVSDTKKPKVMVPPSSPQELEEKRYFVDVEAQKKNLILLNQAIKTCGLPSQLHTMARTLIIEILHMDTVQLGYLFRKYIAYRLIQHARNNIMKRLKAIQNTGKGYEARNLHMMLSRLDDYGKKVMQVWTEKQKSLGQKRNQCLKKMIHVFNQLKKIHELNLSQPIPLIIEEKQIPASTTFVQKPFLKLLMEEDRTSDICKKFRQQEDQTEAIWNVDLSTSSYPIAEKTSMHSLWAQLGGYPDIPRLLQLEVQSTFRKSLASLQSRSSG

SEQ ID NO: 29856 - protein, 359 aa, Homo sapiens
  Payload ID: 5837
  Gene Symbol: FAM186A
  Gene Name: family with sequence similarity 186, member A
  ENSP ID: ENSP00000443703
MSEVSDTSEETQILRDTFAIESFRTFQSHFTKYRTPVYQTPYTDERALLTLMKPTTSPSSLTTLLRTSQISPLEWYQKSRFPPIDKPWILSSVSDTKKPKVMVPPSSPQELEEKRYFVDVEAQKKNLILLNQAIKTCGLPSQLHTMARTLIIEILHMDTVQLGYLFRKYIAYRLIQHARNNIMKRLKAIQNTGKGYEARNLHMMLSRLDDYGKKVMQVWTEKQKSLGQKRNQCLKKMIHVFNQLKKIHELNLSQPIPLIIEEKQIPASTTFVQKPFLKLLMEEDRTSDICKKFRQQEDQTEAIWNVDLSTSSYPIAEKTSMHSLWAQLGGYPDIPRLLQLEVQSTFRKSLASLQSRSSG

SEQ ID NO: 29857 - protein, 893 aa, Homo sapiens
  Payload ID: 5838
  Gene Symbol: FAM186B
  Gene Name: family with sequence similarity 186, member B
  Uniprot ID: Q8IYM0
  ENSP ID: ENSP00000257894
MEKDDPPQLVTPTSVKAIILRIEAAQLTRAQEDISTQLSDILDNVNCVINRFQEELGYDLKENAKSQQRDPKGKKRFILLEKIASFSKDAMMKEKHLYDILRWLGDWGDTLTYEIGPRKSEEEAAALDEWIEVTEKVLPLSLIATKRGIESLTALCSTLIEGQKKRSQVSKRTFWQGWQGRSPQTSPSHPQPLSPEQMLQDQHTMNTKASEVTSMLQELLDSTMFSKGEVRAIRYMATVVENLNKALILQHKENRSLETKYRHLQMQATKELSSQRLHFQQFMEVLESRRDALLKQVEILGGRYHDLLLMKQALEFQLKKAQNATGQAEDLAEVSVDSPGPSERETLPRKETVMEESQQEPMKEEQLFSPLPPSPMAMIRDSGAIAAGHQPLSTMTVRSRVADVFGSKDTESLEPVLLPLVDRRFPKKWERPVAESLGHKDKDQEDYFQKGGLQIKFHCSKQLSLESSRQVTSESQEEPWEEEFGREMRRQLWLEEEEMWQQRQKKWALLEQEHQEKLRQWNLEDLAREQQRRWVQLEKEQESPRREPEQLGEDVERRIFTPTSRWRDLEKAELSLVPAPSRTQSAHQSRRPHLPMSPSTQQPALGKQRPMSSVEFTYRPRTRRVPTKPKKSASFPVTGTSIRRLTWPSLQISPANIKKKVYHMDMEAQRKNLQLLSEESELRLPHYLRSKALELTTTTMELGALRLQYLCHKYIFYRRLQSLRQEAINHVQIMKETEASYKAQNLYIFLENIDRLQSLRLQAWTDKQKGLEEKHRECLSSMVTMFPKLQLEWNVHLNIPEVTSPKPKKCKLPAASPRHIRPSGPTYKQPFLSRHRACVPLQMARQQGKQMEAVWKTEVASSSYAIEKKTPASLPRDQLRGHPDIPRLLTLDV

SEQ ID NO: 29858 - protein, 57 aa, Homo sapiens
  Payload ID: 5838
  Gene Symbol: FAM186B
  Gene Name: family with sequence similarity 186, member B
  ENSP ID: ENSP00000433047
MEKDDPPQLVTPTSVKAIILRIEAAQLTRAQEVAPEMKESLLHWDLMRRLGADPRFE

SEQ ID NO: 29859 - protein, 506 aa, Homo sapiens
  Payload ID: 5838
  Gene Symbol: FAM186B
  Gene Name: family with sequence similarity 186, member B
  ENSP ID: ENSP00000436995
GHQPLSTMTVRSRVADVFGSKDTESLEPVLLPLVDRRFPKKWERPVAESLGHKDKDQEDYFQKGGLQIKFHCSKQLSLESSRQVTSESQEEPWEEEFGREMRRQLWLEEEEMWQQRQKKWALLEQEHQEKLRQWNLEDLAREQQRRWVQLEKEQESPRREPEQLGEDVERRIFTPTSRWRDLEKAELSLVPAPSRTQSAHQSRRPHLPMSPSTQQPALGKQRPMSSVEFTYRPRTRRVPTKPKKSASFPVTGTSIRRLTWPSLQISPANIKKKVYHMDMEAQRKNLQLLSEESELRLPHYLRSKALELTTTTMELGALRLQYLCHKYIFYRRLQSLRQEAINHVQIMKETEASYKAQNLYIFLENIDRLQSLRLQAWTDKQKGLEEKHRECLSSMVTMFPKLQLEWNVHLNIPEVTSPKPKKCKLPAASPRHIRPSGPTYKQPFLSRHRACVPLQMARQQGKQMEAVWKTEVASSSYAIEKKTPASLPRDQLRGHPDIPRLLTLDV

SEQ ID NO: 29860 - protein, 241 aa, Homo sapiens
  Payload ID: 5838
  Gene Symbol: FAM186B
  Gene Name: family with sequence similarity 186, member B
  ENSP ID: ENSP00000448656
MEKDDPPQLVTPTSVKAIILRIEAAQLTRAQEDISTQLSDILDNVNCVINRFQEELGYDLKENAKSQQRDPKGKKRFILLEKIASFSKDAMMKEKHLYDILRWLGDWGDTLTYEIGPRKSEEEAAALDEWIEVTEKVLPLSLIATKRGIESLTALCSTLIEGQKKRSQVSKRTFWQGWQGRSPQTSPSHPQPLSPEQMLQDQHTMNTKASERTKGRNARNLQMNPLSLFKKSQASHSLEPK

SEQ ID NO: 29861 - protein, 117 aa, Homo sapiens
  Payload ID: 5838
  Gene Symbol: FAM186B
  Gene Name: family with sequence similarity 186, member B
  ENSP ID: ENSP00000448989
  MOD_RES (1)..(1): Any amino acid
XCLSSMVTMFPKLQLEWNVHLNIPEVTSPKPKKCKLPAASPRHIRPSGPTYKQPFLSRHRACVPLQMARQQGKQMEAVWKTEVASSSYAIEKKTPASLPRDQLRGHPDIPRLLTLDV

SEQ ID NO: 29862 - protein, 413 aa, Homo sapiens
  Payload ID: 5839
  Gene Symbol: FAM187A
  Gene Name: family with sequence similarity 187, member A
  Uniprot ID: A6NFU0
  ENSP ID: ENSP00000329499
MHLALTTVLLWAWGLQAFEIVEKENIFQRTPCPAFLMFENAAYLADMSFELPCHCKPEEVPAVVWFYQKHLGSSHTKVLTDFDGRVLTEAAQVRVGSDMLTRFSIRMFSLLVFRAQSEDSGLYFCGTRKGDYFYAYDVDIQNSEGMVATFQDKGQEPFADEYYGHLHVFTTFWEWTPCDRCGVRGEQWRIGLCYLQSPDLSPRYLKAVPDVVSCGSRAVPRKLRTKARDHTPEVLVRSCLVPCEKTKTIREGVLAIINYVSKVGSRPWVPQVPIQFHQQRLGHGLIISCPGARPEHAVAWDKDRQHLYRTQYLKGVNRSMRVFIDHGNQLHIRFTQLDDRGIYYCWRQGVLVAGFRLGVTSHGHYPASFSDPETRSAVELTLIGYLLITAVFVTIHFCRCCCYLFHCCPSFSP

SEQ ID NO: 29863 - protein, 242 aa, Homo sapiens; identical to SEQ ID NO: 18211
  Payload ID: 5839
  Gene Symbol: FAM187A
  Gene Name: family with sequence similarity 187, member A
  ENSP ID: ENSP00000391869

SEQ ID NO: 29864 - protein, 369 aa, Homo sapiens
  Payload ID: 5840
  Gene Symbol: FAM187B
  Gene Name: family with sequence similarity 187, member B
  Uniprot ID: Q17R55
  ENSP ID: ENSP00000323355
MPPMLWLLLHFAAPALGFYFSISCPSGKQCQQALLSGNDILLYCNSSGAHWYYLFTQGKKGRLTSLTNISNMEIMPEGSLLIKDPLPSQTGLYHCWNKNGRQVVQYEIDFQDVTTLHITHKDLGQRPLQNETLHLGSKQLIFTWWEPWQDCNRCEEPGECKRLGYRYIEEPLEEAMPCWLYLGEVLVWSSRLRPELQVEACHVQCTNNTQLRVDYVIFDNFRLDEKTEFVWLDCPLGSMYRPVNWRANDTPLTWESQLSGQDFTTFLDPSTGGRQLQVFQPAVYKCFVQQELVAQFKPAASLETLEAQWRENDAQWREARKALRGRADSVLKGLKLVLLVVTVLALLGALLKCIHPSPGRRSTQVLVVK

SEQ ID NO: 29865 - protein, 445 aa, Homo sapiens
  Payload ID: 5841
  Gene Symbol: FAM188A
  Gene Name: family with sequence similarity 188, member A
  Uniprot ID: Q9H8M7
  ENSP ID: ENSP00000277632
MSELTKELMELVWGTKSSPGLSDTIFCRWTQGFVFSESEGSALEQFEGGPCAVIAPVQAFLLKKLLFSSEKSSWRDCSEEEQKELLCHTLCDILESACCDHSGSYCLVSWLRGKTTEETASISGSPAESSCQVEHSSALAVEELGFERFHALIQKRSFRSLPELKDAVLDQYSMWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRVFQTYDPEDNGFIPDSLLEDVMKALDLVSDPEYINLMKNKLDPEGLGIILLGPFLQEFFPDQGSSGPESFTVYHYNGLKQSNYNEKVMYVEGTAVVMGFEDPMLQTDDTPIKRCLQTKWPYIELLWTTDRSPSLN

SEQ ID NO: 29866 - protein, 150 aa, Homo sapiens
  Payload ID: 5841
  Gene Symbol: FAM188A
  Gene Name: family with sequence similarity 188, member A
  ENSP ID: ENSP00000367275
MALVAPEAPSEQARRVFQTYDPEDNGFIPDSLLEDVMKALDLVSDPEYINLMKNKLDPEGLGIILLGPFLQEFFPDQGSSGPESFTVYHYNGLKQSNYNEKVMYVEGTAVVMGFEDPMLQTDDTPIKRCLQTKWPYIELLWTTDRSPSLN

SEQ ID NO: 29867 - protein, 182 aa, Homo sapiens
  Payload ID: 5841
  Gene Symbol: FAM188A
  Gene Name: family with sequence similarity 188, member A
  ENSP ID: ENSP00000388661
LPELKDAVLDQYSMWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRVFQTYDPEDNGFIPDSLLEDVMKALDLVSDPE

SEQ ID NO: 29868 - protein, 164 aa, Homo sapiens
  Payload ID: 5841
  Gene Symbol: FAM188A
  Gene Name: family with sequence similarity 188, member A
  ENSP ID: ENSP00000389883
MKRFPAKKRSFRSLPELKDAVLDQYSMWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRV

SEQ ID NO: 29869 - protein, 757 aa, Homo sapiens
  Payload ID: 5842
  Gene Symbol: FAM188B
  Gene Name: family with sequence similarity 188, member B
  Uniprot ID: Q4G0A6
  ENSP ID: ENSP00000265299
MDSLFVEEVAASLVREFLSRKGLKKTCVTMDQERPRSDLSINNRNDLRKVLHLEFLYKENKAKENPLKTSLELITRYFLDHFGNTANNFTQDTPIPALSVPKKNNKVPSRCSETTLVNIYDLSDEDAGWRTSLSETSKARHDNLDGDVLGNFVSSKRPPHKSKPMQTVPGETPVLTSAWEKIDKLHSEPSLDVKRMGENSRPKSGLIVRGMMSGPIASSPQDSFHRHYLRRSSPSSSSTQPQEESRKVPELFVCTQQDILASSNSSPSRTSLGQLSELTVERQKTTASSPPHLPSKRLPPWDRARPRDPSEDTPAVDGSTDTDRMPLKLYLPGGNSRMTQERLERAFKRQGSQPAPVRKNQLLPSDKVDGELGALRLEDVEDELIREEVILSPVPSVLKLQTASKPIDLSVAKEIKTLLFGSSFCCFNEEWKLQSFSFSNTASLKYGIVQNKGGPCGVLAAVQGCVLQKLLFEGDSKADCAQGLQPSDAHRTRCLVLALADIVWRAGGRERAVVALASRTQQFSPTGKYKADGVLETLTLHSLTCYEDLVTFLQQSIHQFEVGPYGCILLTLSAILSRSTELIRQDFDVPTSHLIGAHGYCTQELVNLLLTGKAVSNVFNDVVELDSGDGNITLLRGIAARSDIGFLSLFEHYNMCQVGCFLKTPRFPIWVVCSESHFSILFSLQPGLLRDWRTERLFDLYYYDGLANQQEQIRLTIDTTQTISEDTDNDLVPPLELCIRTKWKGASVNWNGSDPIL

SEQ ID NO: 29870 - protein, 539 aa, Homo sapiens
  Payload ID: 5843
  Gene Symbol: FAM189A1
  Gene Name: family with sequence similarity 189, member A1
  Uniprot ID: O60320
  ENSP ID: ENSP00000261275
MPPAGGPRAPRPAALPRSLSRLRECPGRSRIVLALGATQMALGCLIVAVSFAALALTTSARVRHSCPFWAGFSVLLSGLIGVVSWKRPLSLVITFFMLLSAVCVMLNLAGSILSCQNAQLVNSLEGCQLIKFDSVEVCVCCELQHQSSGCSNLGETLKLNPLQENCNAVRLTLKDLLFSVCALNVLSTIVCALATAMCCMQMVSSDVLQMFLPQRSHPANPTCVTPHGTVLHQTLDFDEFIPPLPPPPYYPPEYTCTPSTEAQRGLHLDFAPSPFGTLYDVAINSPGLLYPAELPPPYEAVVGQPPASQVTSIGQQVAESSSGDPNTSAGFSTPVPADSTSLLVSEGTATPGSSPSPDGPVGAPAPSEPALPPGHVSPEDPGMGSQVQPGPGRVSRSTSDPTLCTSSMAGDASSHRPSCSQDLEAGLSEAVPGSASMSRSATAACRAQLSPAGDPDTWKTDQRPTPEPFPATSKERPRSLVDSKAYADARVLVAKFLEHSHCALPTEAQHMVGAMRLAVTNEERLEEEAVFGADVLDQV

SEQ ID NO: 29871 - protein, 78 aa, Homo sapiens
  Payload ID: 5843
  Gene Symbol: FAM189A1
  Gene Name: family with sequence similarity 189, member A1
  ENSP ID: ENSP00000452860
MLLSAVCVMLNLAGSILSCQNAQLVNSLEGCQLIKFDSVEVCVCCELQHQSSGCSNLGETLKLNPLQENCNAVRLTLK

SEQ ID NO: 29872 - protein, 539 aa, Homo sapiens
  Payload ID: 5843
  Gene Symbol: FAM189A1
  Gene Name: family with sequence similarity 189, member A1
  ENSP ID: ENSP00000483918
MPPAGGPRAPRPAALPRSLSRLRECPGRSRIVLALGATQMALGCLIVAVSFAALALTTSARVRHSCPFWAGFSVLLSGLIGVVSWKRPLSLVITFFMLLSAVCVMLNLAGSILSCQNAQLVNSLEGCQLIKFDSVEVCVCCELQHQSSGCSNLGETLKLNPLQENCNAVRLTLKDLLFSVCALNVLSTIVCALATAMCCMQMVSSDVLQMFLPQRSHPANPTCVTPHGTVLHQTLDFDEFIPPLPPPPYYPPEYTCTPSTEAQRGLHLDFAPSPFGTLYDVAINSPGLLYPAELPPPYEAVVGQPPASQVTSIGQQVAESSSGDPNTSAGFSTPVPADSTSLLVSEGTATPGSSPSPDGPVGAPAPSEPALPPGRVSPEDPGMGSQVQPGPGHVSRSTSDPTLCTSSMAGDASSHRPSCSQDLEAGLSEAVPGSASMSRSATAACRAQLSPAGDPDTWKTDQRPTPEPFPATSKERPRSLVDSKAYADARVLVAKFLEHSHCALPTEAQHMVGAMRLAVTNEERLEEEAVFGADVLDQV

SEQ ID NO: 29873 - protein, 450 aa, Homo sapiens
  Payload ID: 5844
  Gene Symbol: FAM189A2
  Gene Name: family with sequence similarity 189, member A2
  Uniprot ID: Q15884
  ENSP ID: ENSP00000257515
MILLVNLFVLLSVVCVLLNLAGFILGCQGAQFVSSVPRCDLVDLGEGKICFCCEEFQPAKCTDKENALKLFPVQPCSAVHLLLKKVLFALCALNALTTTVCLVAAALRYLQIFATRRSCIDESQISAEEAEDHGRIPDPDDFVPPVPPPSYFATFYSCTPRMNRRMVGPDVIPLPHIYGARIKGVEVFCPLDPPPPYEAVVSQMDQEQGSSFQMSEGSEAAVIPLDLGCTQVTQDGDIPNIPAEENASTSTPSSTLVRPIRSRRALPPLRTRSKSDPVLHPSEERAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 29874 - protein, 285 aa, Homo sapiens [sequence omitted]

SEQ ID NO: 29875 - protein, 237 aa, Homo sapiens
  Payload ID: 5844
  Gene Symbol: FAM189A2
  Gene Name: family with sequence similarity 189, member A2
  ENSP ID: ENSP00000366422
MTCFGPYPIGTGLQGITLCCFPSFCKMKSRMCMAISICQMLSMLSFVVCAFRYRHMFKRGWPMGTCCLFLPTAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 29876 - protein, 450 aa, Homo sapiens; identical to SEQ ID NO: 29873
  Payload ID: 5844
  Gene Symbol: FAM189A2
  Gene Name: family with sequence similarity 189, member A2
  Uniprot ID: Q15884
  ENSP ID: ENSP00000395675

SEQ ID NO: 29877 - protein, 572 aa, Homo sapiens
  Payload ID: 5845
  Gene Symbol: FAM189B
  Gene Name: family with sequence similarity 189, member B
  Uniprot ID: P81408
  ENSP ID: ENSP00000307128
MMPSPSDSSRSLTSRPSTRGLTHLRLHRPWLQALLTLGLVQVLLGILVVTFSMVASSVTTTESIKRSCPSWAGFSNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 29878 - protein, 668 aa, Homo sapiens
  Payload ID: 5845
  Gene Symbol: FAM189B
  Gene Name: family with sequence similarity 189, member B
  Uniprot ID: P81408
  ENSP ID: ENSP00000354958
MMPSPSDSSRSLTSRPSTRGLTHLRLHRPWLQALLTLGLVQVLLGILVVTFSMVASSVTTTESIKRSCPSWAGFSLAFSGVVGIVSWKRPFTLVISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 29879 - protein, 650 aa, Homo sapiens
  Payload ID: 5845
  Gene Symbol: FAM189B
  Gene Name: family with sequence similarity 189, member B
  Uniprot ID: P81408
  ENSP ID: ENSP00000357352
MMPSPSDSSRSLTSRPSTRGLTHLRLHRPWLQALLTLGLVQVLLGILVVTFSMVASSVTTTESIKRSCPSWAGFSISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTQLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 29880 - protein, 325 aa, Homo sapiens
  Payload ID: 5845
  Gene Symbol: FAM189B
  Gene Name: family with sequence similarity 189, member B
  ENSP ID: ENSP00000427011
MMPSPSDSSRSLTSRPSTRGLTHLRLHRPWLQALLTLGLVQVLLGILVVTFSMVASSVTTTESIKRSCPSWAGFSNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSG

SEQ ID NO: 29881 - protein, 144 aa, Homo sapiens
  Payload ID: 5845
  Gene Symbol: FAM189B
  Gene Name: family with sequence similarity 189, member B
  ENSP ID: ENSP00000427520
MMPSPSDSSRSLTSRPSTRGLTHLRLHRPWLQALLTLGLVQVLLGILVVTFSMVASSVTTTESIKRSCPSWAGFSNLLFSVCGLTICAAIICTLSAIVCCIQIFSLDLVHTLTSGTFIPKCLRKKLLLFPLQIQGSALKPASSA

SEQ ID NO: 29882 - protein, 650 aa, Homo sapiens; identical to SEQ ID NO: 29879
  Payload ID: 5845
  Gene Symbol: FAM189B
  Gene Name: family with sequence similarity 189, member B
  Uniprot ID: P81408
  ENSP ID: ENSP00000458501

SEQ ID NO: 29883 - protein, 325 aa, Homo sapiens; identical to SEQ ID NO: 29880
  Payload ID: 5845
  Gene Symbol: FAM189B
  Gene Name: family with sequence similarity 189, member B
  ENSP ID: ENSP00000458955

SEQ ID NO: 29884 - protein, 572 aa, Homo sapiens; identical to SEQ ID NO: 29877
  Payload ID: 5845
  Gene Symbol: FAM189B
  Gene Name: family with sequence similarity 189, member B
  Uniprot ID: P81408
  ENSP ID: ENSP00000460960

SEQ ID NO: 29885 - protein, 668 aa, Homo sapiens; identical to SEQ ID NO: 29878
  Payload ID: 5845
  Gene Symbol: FAM189B
  Gene Name: family with sequence similarity 189, member B
  Uniprot ID: P81408
  ENSP ID: ENSP00000461152

SEQ ID NO: 29886 - protein, 144 aa, Homo sapiens; identical to SEQ ID NO: 29881
  Payload ID: 5845
  Gene Symbol: FAM189B
  Gene Name: family with sequence similarity 189, member B
  ENSP ID: ENSP00000461337

SEQ ID NO: 29887 - protein, 242 aa, Homo sapiens
  Payload ID: 5845
  Gene Symbol: FAM189B
  Gene Name: family with sequence similarity 189, member B
  ENSP ID: ENSP00000479033
MMPSPSDSSRSLTSRPSTRGLTHLRLHRPWLQALLTLGLVQVLLGILVVTFSMVASSVTTTESIKRSCPSWAGFSNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGGKQILVPLRMRVALSDLQGHYGQGKGMAQVFKYRVTCAYAMGW

SEQ ID NO: 29888 - protein, 242 aa, Homo sapiens; identical to SEQ ID NO: 29887
  Payload ID: 5845
  Gene Symbol: FAM189B
  Gene Name: family with sequence similarity 189, member B
  ENSP ID: ENSP00000479323

SEQ ID NO: 29889 - protein, 133 aa, Homo sapiens [sequence omitted]

SEQ ID NO: 29890 - protein, 133 aa, Homo sapiens [sequence omitted]

SEQ ID NO: 29891 - protein, 52 aa, Homo sapiens [sequence omitted]

SEQ ID NO: 29892 - protein, 131 aa, Homo sapiens
  Payload ID: 5847
  Gene Symbol: FAM19A2
  Gene Name: family with sequence similarity 19 (chemokine (C-C motif)-like), member A2
  Uniprot ID: Q8N3H0
  ENSP ID: ENSP00000393987
MSKRYLQKATKGKLLIIIFIVTLWGKVVSSANHHKAHHVKTGTCEVVALHRCCNKNKIEERSQTVKCSCFPGQVAGTTRAAPSCVDASIVEQKWWCHMQPCLEGEECKVLPDRKGWSCSSGNKVKTTRVTH

SEQ ID NO: 29893 - protein, 101 aa, Homo sapiens
  Payload ID: 5847
  Gene Symbol: FAM19A2
  Gene Name: family with sequence similarity 19 (chemokine (C-C motif)-like), member A2
  ENSP ID: ENSP00000447280
MVTPITRMSKRYLQKATKGKLLIIIFIVTLWGKVVSSANHHKAHHVKTGTCEVVALHRCCNKNKIEERSQTVKCSCFPGQVAGTTRAAPSCVDASIVEQKW

SEQ ID NO: 29894 - protein, 131 aa, Homo sapiens; identical to SEQ ID NO: 29892
  Payload ID: 5847
  Gene Symbol: FAM19A2
  Gene Name: family with sequence similarity 19 (chemokine (C-C motif)-like), member A2
  Uniprot ID: Q8N3H0
  ENSP ID: ENSP00000447305

SEQ ID NO: 29895 - protein, 131 aa, Homo sapiens
  Payload ID: 5847
  Gene Symbol: FAM19A2
  Gene Name: family with sequence similarity 19 (chemokine (C-C motif)-like), member A2
  ENSP ID: ENSP00000447584
MSKRYLQKATKGKLLIIIFIVTLWGKVVSSANHHKAHHVKTGTCEVVALHRCCNKNKIEERSQTVKCSCFPGQVAGTTRAAPSCVDASIVEQKWWCHMQPCLEGEECKVLPDRKGWSCSSGNKVKTTRANV

SEQ ID NO: 29896 - protein, 87 aa, Homo sapiens
  Payload ID: 5847
  Gene Symbol: FAM19A2
  Gene Name: family with sequence similarity 19 (chemokine (C-C motif)-like), member A2
  ENSP ID: ENSP00000449310
MMSKRYLQKATKGKLLIIIFIVTLWGKVVSSANHHKAHHVKTGTCEVVALHRCCNKNKIEERSQTVKCSCFPGQVAGTTRAAPSCVD

SEQ ID NO: 29897 - protein, 34 aa, Homo sapiens
  Payload ID: 5847
  Gene Symbol: FAM19A2
  Gene Name: family with sequence similarity 19 (chemokine (C-C motif)-like), member A2
  Uniprot ID: Q8N3H0
  ENSP ID: ENSP00000449457
MQPCLEGEECKVLPDRKGWSCSSGNKVKTTRVTH

SEQ ID NO: 29898 - protein, 110 aa, Homo sapiens
  Payload ID: 5847
  Gene Symbol: FAM19A2
  Gene Name: family with sequence similarity 19 (chemokine (C-C motif)-like), member A2
  ENSP ID: ENSP00000449516
MMSKRYLQKATKGKLLIIIFIVTLWGKVVSSANHHKAHHVKTGTCEVVALHRCCNKNKIEERSQTVKCSCFPGQVAGTTRAAPSCVDASIVEQKWWCHMQPCLEGEECKV

SEQ ID NO: 29899 - protein, 49 aa, Homo sapiens
  Payload ID: 5847
  Gene Symbol: FAM19A2
  Gene Name: family with sequence similarity 19 (chemokine (C-C motif)-like), member A2
  ENSP ID: ENSP00000449632
MSKRYLQKATKGKLLIIIFIVTLWGKVVSSANHHKGNPLTQEKSSDPQG

SEQ ID NO: 29900 - protein, 133 aa, Homo sapiens
  Payload ID: 5848
  Gene Symbol: FAM19A3
  Gene Name: family with sequence similarity 19 (chemokine (C-C motif)-like), member A3
  Uniprot ID: Q7Z5A8
  ENSP ID: ENSP00000355042
MSERVERNWSTGGWLLALCLAWLWTHLTLAALQPPTATVLVQQGTCEVIAAHRCCNRNRIEERSQTVKCSCFSGQVAGTTRAKPSCVDASIVLQRWWCQMEPCLPGEECKVLPDLSGWSCSSGHKVKTTKVTR

SEQ ID NO: 29901 - protein, 169 aa, Homo sapiens
  Payload ID: 5848
  Gene Symbol: FAM19A3
  Gene Name: family with sequence similarity 19 (chemokine (C-C motif)-like), member A3
  Uniprot ID: Q7Z5A8
  ENSP ID: ENSP00000358644
MSERVERNWSTGGWLLALCLAWLWTHLTLAALQPPTATVLVQQGTCEVIAAHRCCNRNRIEERSQTVKCSCFSGQVAGTTRAKPSCVDDLLLAAHCARRDPRAALRLLLPQPPSSCRDGGVRWSPACRGRSVRCSRTCRDGAAAVDTKSKPPRSHDSSWGSRPGQERLD

SEQ ID NO: 29902 - protein, 140 aa, Homo sapiens
  Payload ID: 5849
  Gene Symbol: FAM19A4
  Gene Name: family with sequence similarity 19 (chemokine (C-C motif)-like), member A4
  Uniprot ID: Q96LR4
  ENSP ID: ENSP00000295569
MRSPRMRVCAKSVLLSHWLFLAYVLMVCCKLMSASSQHLRGHAGHHQIKQGTCEVVAVHRCCNKNRIEERSQTVKCSCFPGQVAGTTRAQPSCVEASIVIQKWWCHMNPCLEGEDCKVLPDYSGWSCSSGNKVKTTKVTR

SEQ ID NO: 29903 - protein, 77 aa, Homo sapiens
  Payload ID: 5849
  Gene Symbol: FAM19A4
  Gene Name: family with sequence similarity 19 (chemokine (C-C motif)-like), member A4
  ENSP ID: ENSP00000419439
MRSPRMRVCAKSVLLSHWLFLAYVLMVCCKLMSASSQHLRGHAGHHQIKQGTCEVVAVHRCCNKNRIEERSQTVKCS

SEQ ID NO: 29904 - protein, 57 aa, Homo sapiens
  Payload ID: 5849
  Gene Symbol: FAM19A4
  Gene Name: family with sequence similarity 19 (chemokine (C-C motif)-like), member A4
  ENSP ID: ENSP00000489092
MRSPRMRVCAKSVLLSHWLFLAYVLMVCCKLMSASSQHLRGHAGHHQIKQGTCEVVA

SEQ ID NO: 29905 - protein, 181 aa, Homo sapiens
  Payload ID: 5850
  Gene Symbol: FAM19A5
  Gene Name: family with sequence similarity 19 (chemokine (C-C motif)-like), member A5
  ENSP ID: ENSP00000336812
MAPSPRTGSRQDATALPSMSSTFWAFMILASLLIAYCSQLAAGTCEIVTLDRDSSQPRRTIARQTARCACRKGQIAGTTRARPACVDARIIKTKQWCDMLPCLEGEGCDLLINRSGWTCTQPGGRIKTTTSPSKPPKRAPPGIPSCRQRAGGSLGSRDLRTSLLCQGSHLADRRRWLRPSQ

SEQ ID NO: 29906 - protein, 125 aa, Homo sapiens
  Payload ID: 5850
  Gene Symbol: FAM19A5
  Gene Name: family with sequence similarity 19 (chemokine (C-C motif)-like), member A5
  Uniprot ID: Q7Z5A7
  ENSP ID: ENSP00000351043
MQLLKALWALAGAALCCFLVLVIHAQFLKEGQLAAGTCEIVTLDRDSSQPRRTIARQTARCACRKGQIAGTTRARPACVDARIIKTKQWCDMLPCLEGEGCDLLINRSGWTCTQPGGRIKTTTVS

SEQ ID NO: 29907 - protein, 132 aa, Homo sapiens
  Payload ID: 5850
  Gene Symbol: FAM19A5
  Gene Name: family with sequence similarity 19 (chemokine (C-C motif)-like), member A5
  Uniprot ID: Q7Z5A7
  ENSP ID: ENSP00000383933
MAPSPRTGSRQDATALPSMSSTFWAFMILASLLIAYCSQLAAGTCEIVTLDRDSSQPRRTIARQTARCACRKGQIAGTTRARPACVDARIIKTKQWCDMLPCLEGEGCDLLINRSGWTCTQPGGRIKTTTVS

SEQ ID NO: 29908 - protein, 53 aa, Homo sapiens
  Payload ID: 5850
  Gene Symbol: FAM19A5
  Gene Name: family with sequence similarity 19 (chemokine (C-C motif)-like), member A5
  Uniprot ID: Q7Z5A7
  ENSP ID: ENSP00000385603
MYHHREWPARIIKTKQWCDMLPCLEGEGCDLLINRSGWTCTQPGGRIKTTTVS

SEQ ID NO: 29909 - protein, 254 aa, Homo sapiens
  Payload ID: 5851
  Gene Symbol: FAM192A
  Gene Name: family with sequence similarity 192, member A
  Uniprot ID: Q9GZU8
  ENSP ID: ENSP00000335808
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHKSSESGNSVKRLKPDPEPDDKNQEPSSCKSLGNTSLSGPSIHCPSAAVCIGILPGLGAYSGSSDSESSSDSEGTINATGKIVSSIFRTNTFLEAP

SEQ ID NO: 29910 - protein, 254 aa, Homo sapiens; identical to SEQ ID NO: 29909
  Payload ID: 5851
  Gene Symbol: FAM192A
  Gene Name: family with sequence similarity 192, member A
  Uniprot ID: Q9GZU8
  ENSP ID: ENSP00000374098

SEQ ID NO: 29911 - protein, 165 aa, Homo sapiens
  Payload ID: 5851
  Gene Symbol: FAM192A
  Gene Name: family with sequence similarity 192, member A
  ENSP ID: ENSP00000454596
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHKSSESG

SEQ ID NO: 29912 - protein, 64 aa, Homo sapiens
  Payload ID: 5851
  Gene Symbol: FAM192A
  Gene Name: family with sequence similarity 192, member A
  ENSP ID: ENSP00000454649
MDGGDDGNLIIKKRFVSEAELDERRKRRQEEWEKVRKPEDPEECPEEVYDPRSLYERLQEQKDR

SEQ ID NO: 29913 - protein, 154 aa, Homo sapiens
  Payload ID: 5851
  Gene Symbol: FAM192A
  Gene Name: family with sequence similarity 192, member A
  ENSP ID: ENSP00000454901
  MOD_RES (1)..(1): Any amino acid
XNGAKGGKKNGRKFENLKIQKVGISQENKKEVEKKLTVKPIETKNKFSQAKLLAGAVKHKSSESGNSVKRLKPDPEPDDKNQEPSSCKSLGNTSLSGPSIHCPSAAVCIGILPGLGAYSGSSDSESSSDSEGTINATGKIVSSIFRTNTFLEAP

SEQ ID NO: 29914 - protein, 81 aa, Homo sapiens
  Payload ID: 5851
  Gene Symbol: FAM192A
  Gene Name: family with sequence similarity 192, member A
  ENSP ID: ENSP00000455082
MDGGDDGNLIIKKRFVSEAELDERRKRRQEEWEKVRKPEDPEECPEEVYDPRSLYERLQEQKDRKQQEYEEQFKFKNMFDP

SEQ ID NO: 29915 - protein, 148 aa, Homo sapiens
  Payload ID: 5851
  Gene Symbol: FAM192A
  Gene Name: family with sequence similarity 192, member A
  ENSP ID: ENSP00000455170
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFS

SEQ ID NO: 29916 - protein, 27 aa, Homo sapiens
  Payload ID: 5851
  Gene Symbol: FAM192A
  Gene Name: family with sequence similarity 192, member A
  ENSP ID: ENSP00000455299
MDGGDDGNLIIKKRFVSEAELDERRKR

SEQ ID NO: 29917 - protein, 24 aa, Homo sapiens
  Payload ID: 5851
  Gene Symbol: FAM192A
  Gene Name: family with sequence similarity 192, member A
  ENSP ID: ENSP00000455325
MDGGDDGNLIIKKRFVSEAELDER

SEQ ID NO: 29918 - protein, 96 aa, Homo sapiens
  Payload ID: 5851
  Gene Symbol: FAM192A
  Gene Name: family with sequence similarity 192, member A
  ENSP ID: ENSP00000455890
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQ

SEQ ID NO: 29919 - protein, 254 aa, Homo sapiens; identical to SEQ ID NO: 29909
  Payload ID: 5851
  Gene Symbol: FAM192A
  Gene Name: family with sequence similarity 192, member A
  Uniprot ID: Q9GZU8
  ENSP ID: ENSP00000456211

SEQ ID NO: 29920 - protein, 88 aa, Homo sapiens
  Payload ID: 5851
  Gene Symbol: FAM192A
  Gene Name: family with sequence similarity 192, member A
  ENSP ID: ENSP00000456673
MDGGDDGNLIIKKRFVSEAELDERRKRRQEEWEKVRKPEDPEECPEEVYDPRSLYERLQEQKDRKQQEYEEQFKFKNMVRGLDEDETN

SEQ ID NO: 29921 - protein, 140 aa, Homo sapiens
  Payload ID: 5851
  Gene Symbol: FAM192A
  Gene Name: family with sequence similarity 192, member A
  ENSP ID: ENSP00000456931
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKP

SEQ ID NO: 29922 - protein, 106 aa, Homo sapiens
  Payload ID: 5851
  Gene Symbol: FAM192A
  Gene Name: family with sequence similarity 192, member A
  ENSP ID: ENSP00000457185
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRRE

SEQ ID NO: 29923 - protein, 130 aa, Homo sapiens
  Payload ID: 5851
  Gene Symbol: FAM192A
  Gene Name: family with sequence similarity 192, member A
  ENSP ID: ENSP00000457269
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKK

SEQ ID NO: 29924 - protein, 177 aa, Homo sapiens
  Payload ID: 5851
  Gene Symbol: FAM192A
  Gene Name: family with sequence similarity 192, member A
  ENSP ID: ENSP00000457532
MVRGLDEDETNFLDEVSRQQELIEKQRREEELKELKEYRNNLKKVGISQENKKEVEKKLTVKPIETKNKFSQAKLLAGAVKHKSSESGNSVKRLKPDPEPDDKNQEPSSCKSLGNTSLSGPSIHCPSAAVCIGILPGLGAYSGSSDSESSSDSEGTINATGKIVSSIFRTNTFLEAP

SEQ ID NO: 29925 - protein, 160 aa, Homo sapiens
  Payload ID: 5851
  Gene Symbol: FAM192A
  Gene Name: family with sequence similarity 192, member A
  ENSP ID: ENSP00000457695
MDGGDDGNLIIKKRFVSEAELDERRKRRQEEWEKVRKPEDPEECPEEVYDPRSLYERLQEQKDRKQQEYEEQFKFKNMVRGLDEDETNFLDEVSRQQELIEKQRREEELKELKEYRNNLKKVGISQENKKEVEKKLTVKPIETKNKFSQAKLLAGAVKHK

SEQ ID NO: 29926 - protein, 254 aa, Homo sapiens; identical to SEQ ID NO: 29909
  Payload ID: 5851
  Gene Symbol: FAM192A
  Gene Name: family with sequence similarity 192, member A
  Uniprot ID: Q9GZU8
  ENSP ID: ENSP00000457740

SEQ ID NO: 29927 - protein, 254 aa, Homo sapiens; identical to SEQ ID NO: 29909
  Payload ID: 5851
  Gene Symbol: FAM192A
  Gene Name: family with sequence similarity 192, member A
  Uniprot ID: Q9GZU8
  ENSP ID: ENSP00000457850

SEQ ID NO: 29928 - protein, 1265 aa, Homo sapiens
  Payload ID: 5852
  Gene Symbol: FAM193A
  Gene Name: family with sequence similarity 193, member A
  Uniprot ID: P78312
  ENSP ID: ENSP00000324587
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDGVSLLLPSLGYNGAILAHCNLRLPGSSDCAASASQVVGITDDVFLPKDIDLDSVDMDETEREVEYFKRFCLDSARQTRQRLSINWSNFSLKKATFAAH

SEQ ID NO: 29929 - protein, 1224 aa, Homo sapiens
  Payload ID: 5852
  Gene Symbol: FAM193A
  Gene Name: family with sequence similarity 193, member A
  Uniprot ID: P78312
  ENSP ID: ENSP00000372290
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDETEREVEYFKRFCLDSARQTRQRLSINWSNFSLKKATFAAH

SEQ ID NO: 29930 - protein, 1211 aa, Homo sapiens
  Payload ID: 5852
  Gene Symbol: FAM193A
  Gene Name: family with sequence similarity 193, member A
  Uniprot ID: P78312
  ENSP ID: ENSP00000421200
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDETEREVEYFKRDGVSPHCPGWSRTPGLK

SEQ ID NO: 29931 - protein, 804 aa, Homo sapiens
  Payload ID: 5852
  Gene Symbol: FAM193A
  Gene Name: family with sequence similarity 193, member A
  ENSP ID: ENSP00000421369
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGVSA

SEQ ID NO: 29932 - protein, 43 aa, Homo sapiens
  Payload ID: 5852
  Gene Symbol: FAM193A
  Gene Name: family with sequence similarity 193, member A
  ENSP ID: ENSP00000423292
MKVRLLRQLSAAAKVKAPSGLQGPPQAHQFISLLLEEYGALCQ

SEQ ID NO: 29933 - protein, 792 aa, Homo sapiens
  Payload ID: 5852
  Gene Symbol: FAM193A
  Gene Name: family with sequence similarity 193, member A
  Uniprot ID: P78312
  ENSP ID: ENSP00000423852
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEASSCTNK

SEQ ID NO: 29934 - protein, 1006 aa, Homo sapiens
  Payload ID: 5852
  Gene Symbol: FAM193A
  Gene Name: family with sequence similarity 193, member A
  ENSP ID: ENSP00000427260
MTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFCSDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNK

SEQ ID NO: 29935 - protein, 1246 aa, Homo sapiens
  Payload ID: 5852
  Gene Symbol: FAM193A
  Gene Name: family with sequence similarity 193, member A
  Uniprot ID: P78312
  ENSP ID: ENSP00000427505
MKVRLLRQLSAAAKVKAPSGLQGPPQAHQFISLLLEEYGALCQAARSISTFLGTLENEHLKKFQVTWELHNKHLFENLVFSEPLLQSNLPALVSQIRLGTTTHDTCSEDTYSTLLQRYQRSEEELRRVAEEWLECQKRIDAYVDEQDLQTSVNKSIDTGTLVQSWLRGAAMTMKTKQRMLTEDWELFKQRRFIEEQLTNKKAVTGENNFTDTMRHMLSSRLSMPDCPNCNYRRRCACDDCSLSHILTCGIMDPPVTDDIHIHQLPLQVDPAPDYLAERSPPSVSSASSGSGSSSPITIQQHPRLILTDSGSAPTFDDEDVAPLSAKFADIYPLSNYDDTEVVANMNGIHSELNGGGENMALKDESPQISSTSSSSSEADDEEADGESSGEPPGAPKEDGVLGSRSPRTEESKADSPPPSYPTQQAEQAPNTCECHVCKQEASGLTPSAMTAGALPPGHQFLSPEKPTHPALHLYPHIHGHVPLHTVPHLPRPLIHPTLYATPPFTHSKALPPAPVQNHTNKHQVFNASLQDHIYPSCFGNTPEWNSSKFISLWGSEVMNDKNWNPGTFLPDTISGSEILGPTLSETRPEALPPPSSNETPAVSDSKEKKNAAKKKCLYNFQDAFMEANKVVMATSSATSSVSCTATTVQSSNSQFRVSSKRPPSVGDVFHGISKEDHRHSAPAAPRNSPTGLAPLPALSPAALSPAALSPASTPHLANLAAPSFPKTATTTPGFVDTRKSFCPAPLPPATDGSISAPPSVCSDPDCEGHRCENGVYDPQQDDGDESADEDSCSEHSSSTSTSTNQKEGKYCDCCYCEFFGHGGPPAAPTSRNYAEMREKLRLRLTKRKEEQPKKMDQISERESVVDHRRVEDLLQFINSSETKPVSSTRAAKRARHKQRKLEEKARLEAEARAREHLHLQEEQRRREEEEDEEEEEDRFKEEFQRLQELQKLRAVKKKKKERPSKDCPKLDMLTRNFQAATESVPNSGNIHNGSLEQTEEPETSSHSPSRHMNHSEPRPGLGADGDAADPVDTRDSKFLLPKEVNGKQHEPLSFFFDIMQHHKEGNGKQKLRQTSKASSEPARRPTEPPKATEGQSKPRAQTESKAKVVDLMSITEQKREERKVNSNNNNKKQLNHIKDEKSNPTPMEPTSPGEHQQNSKLVLAESPQPKGKNKKNKKKKGDRVNNSIDDVFLPKDIDLDSVDMDETEREVEYFKRFCLDSARQTRQRLSINWSNFSLKKATFAAH

SEQ ID NO: 29936 - protein, 1211 aa, Homo sapiens; identical to SEQ ID NO: 29930
  Payload ID: 5852
  Gene Symbol: FAM193A
  Gene Name: family with sequence similarity 193, member A
  Uniprot ID: P78312
  ENSP ID: ENSP00000443617

SEQ ID NO: 29937 - protein, 822 aa, Homo sapiens
  Payload ID: 5853
  Gene Symbol: FAM193B
  Gene Name: family with sequence similarity 193, member B
  Uniprot ID: Q96PV7
  ENSP ID: ENSP00000422131
MTRRRSRPSGGAGRRERARAAGPQKPQAPEPPPPPSLEAGAGAGPPEAPAEPDHDGPREDDEPNLVPGPQVPPASSQPVQTCCLLCHRERKGWEEGPSQNGLVLQGEKLPPDFMPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPGEAFPVSEHHQHSDLTAPPNSPTGHHPQPASLIPSHPSSFGSPPHPHLLPTTPAAPFPAQASECPVAAATAPHTPGPCQSSHLPSTSMPLLKMPPPFSGCSHPCSGHCGGHCSGPLLPPPSSQPLPSTHRDPGCKGHKFAHSGLACQLPQPCEADEGLGEEEDSSSERSSCTSSSTHQRDGKFCDCCYCEFFGHNAEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPSGPARPQSLPQGKGRSRRSRNKQEKPASSLDDVFLPKDMDGVEMDETDREVEYFKRFCLDSAKQTRQKVAVNWTNFSLKKTTPSTAQ

SEQ ID NO: 29938 - protein, 30 aa, Homo sapiens
  Payload ID: 5853
  Gene Symbol: FAM193B
  Gene Name: family with sequence similarity 193, member B
  ENSP ID: ENSP00000423855
  MOD_RES (1)..(1): Any amino acid
XDMDGVEMDETDREVEYFKSTLGGRGGWIT

SEQ ID NO: 29939 - protein, 72 aa, Homo sapiens
  Payload ID: 5853
  Gene Symbol: FAM193B
  Gene Name: family with sequence similarity 193, member B
  ENSP ID: ENSP00000423911
MPKLVKNLLGEMPLWVCQSCRKSMEEDERQTGREHAVAISLSHTSCKSQSCGDDSHSSSSSSSSSSSSSSSS

SEQ ID NO: 29940 - protein, 139 aa, Homo sapiens
  Payload ID: 5853
  Gene Symbol: FAM193B
  Gene Name: family with sequence similarity 193, member B
  ENSP ID: ENSP00000424052
SAKGQVAGPKQPGRVLELPKVGSCAEAGEGSRGSRPGPGWAGSPKTEKEKGSSWRNWPGEAKARPQEQESVQPSGPARPQSLPQGKGRSRRSRNKQEKPASSLDDVFLPKDMDGVEMDETDREVEYFKSTLGGRGGWIT

SEQ ID NO: 29941 - protein, 73 aa, Homo sapiens
  Payload ID: 5853
  Gene Symbol: FAM193B
  Gene Name: family with sequence similarity 193, member B
  ENSP ID: ENSP00000424300
EAGAGAGPPEAPAEPDHDGPREDDEPNLVPGPQRLQPRPPQQLCLLAPPRHTQQSSWSRQPGCPEEFLVGFLH

SEQ ID NO: 29942 - protein, 78 aa, Homo sapiens
  Payload ID: 5853
  Gene Symbol: FAM193B
  Gene Name: family with sequence similarity 193, member B
  ENSP ID: ENSP00000424652
MPKLVKNLLGEMPLWVCQSCRKSMEEDERQTGREHAVAISLSHTSCKSQSCGDDSHSSSSSSSSSSSSSSSSCPGNSG

SEQ ID NO: 29943 - protein, 142 aa, Homo sapiens
  Payload ID: 5853
  Gene Symbol: FAM193B
  Gene Name: family with sequence similarity 193, member B
  ENSP ID: ENSP00000424961
MTRRRSRPSGGAGRRERARAAGPQKPQAPEPPPPPSLEAGAGAGPPEAPAEPDHDGPREDDEPNLVPGPQVGASGETSAARALSPSPSGSGSGAGLGMGHPAAAGVAAFPRVRRRSFLPRGGNGGWTPLPKAEARSALLRLG

SEQ ID NO: 29944 - protein, 120 aa, Homo sapiens
  Payload ID: 5853
  Gene Symbol: FAM193B
  Gene Name: family with sequence similarity 193, member B
  ENSP ID: ENSP00000425002
MPKLVKNLLGEMPLWVCQSCRKSMEEDERQTGREHAVAISLSHTSCKSQSCGDDSHSSSSSSSSSSSSSSSSCPGNSGDWDPSSFLSAHKLSGLWNSPHSSGAMPGSSLGSPPTIPACRS

SEQ ID NO: 29945 - protein, 45 aa, Homo sapiens
  Payload ID: 5853
  Gene Symbol: FAM193B
  Gene Name: family with sequence similarity 193, member B
  ENSP ID: ENSP00000425173
MPKLVKNLLGEMPLWVCQSCRKSMEEDERQTGREHAVAISLSHTS

SEQ ID NO: 29946 - protein, 108 aa, Homo sapiens
  Payload ID: 5853
  Gene Symbol: FAM193B
  Gene Name: family with sequence similarity 193, member B
  ENSP ID: ENSP00000425310
  MOD_RES (1)..(1): Any amino acid
XPSSQPLPSTHRDPGCKGHKFAHSGLACQLPQPCEADEGLGEEEDSSSERSSCTSSSTHQRDGKFCDCCYCEFFGHNARSERLGVMKAEWKQKGSQSPKCDSQPRDRP

SEQ ID NO: 29947 - protein, 508 aa, Homo sapiens
  Payload ID: 5853
  Gene Symbol: FAM193B
  Gene Name: family with sequence similarity 193, member B
  ENSP ID: ENSP00000432463
  MOD_RES (1)..(1): Any amino acid
XERSSCTSSSTHQRDGKFCDCCYCEFFGHNAPPAAPTSRNYTEIREKLRSRLTRRKEELPMKGGTLGGIPGEPAVDHRDVDELLEFINSTEPKVPNSARAAKRARHKLKKKEKEKAQLAAEALKQANRVSGSREPRPARERLLEWPDRELDRVNSFLSSRLQEIKNTVKDSIRASFSVCELSMDSNGFSKEGAAEPEPQSLPPSNLSGSSEQQPDINLDLSPLTLGSPQNHTLQAPGEPAPPWAEMRGPHPPWTEVRGPPPGIVPENGLVRRLNTVPNLSRVIWVKTPKPGYPSSEEPSSKEVPSCKQELPEPVSSGGKPQKGKRQGSQAKKSEASPAPRPPASLEVPSAKGQVAGPKQPGRVLELPKVGSCAEAGEGSRGSRPGPGWAGSPKTEKEKGSSWRNWPGEAKARPQEQESVQPSGPARPQSLPQGKGRSRRSRNKQEKPASSLDDVFLPKDMDGVEMDETDREVEYFKRFCLDSAKQTRQKVAVNWTNFSLKKTTPSTAQ

SEQ ID NO: 29948 - protein, 160 aa, Homo sapiens
  Payload ID: 5854
  Gene Symbol: FAM195A
  Gene Name: family with sequence similarity 195, member A
  Uniprot ID: Q9BUT9
  ENSP ID: ENSP00000305138
MYTITKGPSKLVAQRRTGPTQQQVEGRLGELLKCRQPAPPTSQPPRAQPFAQPPGPWPLSSPGPRLVFNRVNGRRAPSTSPSFEGTQETYTVAHEENVRFVSEAWQQVQQQLDGGPAGEGGPRPVQYVERTPNPRLQNFVPIDLDEWWAQQFLARITSCS

SEQ ID NO: 29949 - protein, 75 aa, Homo sapiens
  Payload ID: 5854
  Gene Symbol: FAM195A
  Gene Name: family with sequence similarity 195, member A
  Uniprot ID: Q9BUT9
  ENSP ID: ENSP00000433876
MYTITKGPSKLVAQRRTGPTQQQVEGRLGELLKCRQPAPPTSQPPRAQPFAQPPGPWPLSSLAAGATAAGWWPSR

SEQ ID NO: 29950 - protein, 65 aa, Homo sapiens
  Payload ID: 5854
  Gene Symbol: FAM195A
  Gene Name: family with sequence similarity 195, member A
  ENSP ID: ENSP00000458625
MYTITKGPSKLVAQRRTGPTQQQVEGRLGELLKCRQPAPPTSQPPRAQPFAQPPGPWPLSSAPLS

SEQ ID NO: 29951 - protein, 65 aa, Homo sapiens; identical to SEQ ID NO: 29950
  Payload ID: 5854
  Gene Symbol: FAM195A
  Gene Name: family with sequence similarity 195, member A
  ENSP ID: ENSP00000486924

SEQ ID NO: 29952 - protein, 118 aa, Homo sapiens
  Payload ID: 5855
  Gene Symbol: FAM195B
  Gene Name: family with sequence similarity 195, member B
  ENSP ID: ENSP00000408827
MLPHQRLRGSGGGALGSDAPAMTSSPVSRVVYNGKRTSSPRSPPSSSEIFTPAHEENVRFIYEAWQGVERDLRGQVPGGERGLVEEYVEKVPNPSLKTFKPIDLSDLKRRSTQDAKKS

SEQ ID NO: 29953 - protein, 97 aa, Homo sapiens
  Payload ID: 5855
  Gene Symbol: FAM195B
  Gene Name: family with sequence similarity 195, member B
  Uniprot ID: C9JLW8
  ENSP ID: ENSP00000409009
MTSSPVSRVVYNGKRTSSPRSPPSSSEIFTPAHEENVRFIYEAWQGVERDLRGQVPGGERGLVEEYVEKVPNPSLKTFKPIDLSDLKRRSTQDAKKS

SEQ ID NO: 29954 - protein, 97 aa, Homo sapiens; identical to SEQ ID NO: 29953
  Payload ID: 5855
  Gene Symbol: FAM195B
  Gene Name: family with sequence similarity 195, member B
  Uniprot ID: C9JLW8
  ENSP ID: ENSP00000445543

SEQ ID NO: 29955 - protein, 97 aa, Homo sapiens; identical to SEQ ID NO: 29953
  Payload ID: 5855
  Gene Symbol: FAM195B
  Gene Name: family with sequence similarity 195, member B
  Uniprot ID: C9JLW8
  ENSP ID: ENSP00000458707

SEQ ID NO: 29956 - protein, 97 aa, Homo sapiens; identical to SEQ ID NO: 29953
  Payload ID: 5855
  Gene Symbol: FAM195B
  Gene Name: family with sequence similarity 195, member B
  Uniprot ID: C9JLW8
  ENSP ID: ENSP00000458720

SEQ ID NO: 29957 - protein, 92 aa, Homo sapiens
  Payload ID: 5855
  Gene Symbol: FAM195B
  Gene Name: family with sequence similarity 195, member B
  ENSP ID: ENSP00000459769
MTRVVYNGKRTSSPRSPPSSSEIFTPAHEENVRFIYEAWQGVERDLRGQVPGGERGLVEEYVEKVPNPSLKTFKPIDLSDLKRRSTQDAKKS

SEQ ID NO: 29958 - protein, 117 aa, Homo sapiens
  Payload ID: 5855
  Gene Symbol: FAM195B
  Gene Name: family with sequence similarity 195, member B
  ENSP ID: ENSP00000460100
MTSSPVSRVVYNGKRTSSPRSPPSSSEIFTPAHEENVRFIYEAWQGVERDLRGQVPGGERGLVEEYVEKVPNPSLKSEWGLTWGQGWAGRPGLMGRRGLCPPPTALSPGSLQAHRPE

SEQ ID NO: 29959 - protein, 63 aa, Homo sapiens
  Payload ID: 5855
  Gene Symbol: FAM195B
  Gene Name: family with sequence similarity 195, member B
  ENSP ID: ENSP00000460299
MTSSPVSRVVYNGKRTSSPRSPPSSSEIFTPAHEENVRFIYEAFKPIDLSDLKRRSTQDAKKS

SEQ ID NO: 29960 - protein, 78 aa, Homo sapiens
  Payload ID: 5855
  Gene Symbol: FAM195B
  Gene Name: family with sequence similarity 195, member B
  ENSP ID: ENSP00000460329
MRQAPPAPPSPESCTTARGPAAPAPHPAAARSSPQPTRRTSASFTKPGRVWSETCEARCRVASGAWWRSMWRRSLTPA

SEQ ID NO: 29961 - protein, 118 aa, Homo sapiens; identical to SEQ ID NO: 29952
  Payload ID: 5855
  Gene Symbol: FAM195B
  Gene Name: family with sequence similarity 195, member B
  ENSP ID: ENSP00000460461

SEQ ID NO: 29962 - protein, 118 aa, Homo sapiens; identical to SEQ ID NO: 29952
  Payload ID: 5855
  Gene Symbol: FAM195B
  Gene Name: family with sequence similarity 195, member B
  ENSP ID: ENSP00000461433

SEQ ID NO: 29963 - protein, 455 aa, Homo sapiens
  Payload ID: 5856
  Gene Symbol: FAM196A
  Gene Name: family with sequence similarity 196, member A
  Uniprot ID: Q6ZSG2
  ENSP ID: ENSP00000428730
MVSKDTGKCILTTSESEVEPAACLALEMKYALDPNRQIKKRNKALQVRFKDICEAQNEQRDTQLSSGQLGEKREAKPVSCRAAYRKYMTVPARRSIPNVTKSTGVQTSPDLKKCYQTFPLDRKKGNLKSLPAADPFKSQNNGFLTDAKEKNEAGPMEEARPCGAGRVHKTTALVFHSNQHMNTVDQPLGVNCTEPCKSPEPLSYGEAALQNSTRPPSEEPDYQLLGRAKQDRGRPNSEEPAPPALRRVFKTEVATVYAPALSARAPEPGLSDSAAASQWSLCPADDERRRATHLNGLQAPSETALACSPPMQCLSPECSEQPSQTHTPPGLGNQPSPTAVAAGEECQRIVPHTEVVDLKAQLQMMENLISSSQETIKVLLGVIQELEKGEAHREGVELDFKQQEDKLQPVLRKLHPIEETQVIPSPYSQETYSSTPKQKSKTESKKHGRWKLWFL

SEQ ID NO: 29964 - protein, 479 aa, Homo sapiens
  Payload ID: 5856
  Gene Symbol: FAM196A
  Gene Name: family with sequence similarity 196, member A
  Uniprot ID: Q6ZSG2
  ENSP ID: ENSP00000429763
MVSKDTGKCILTTSESEVEPAACLALEMKYALDPNRQIKKRNKALQVRFKDICEAQNEQRDTQLSSGQLGEKREAKPVSCRAAYRKYMTVPARRSIPNVTKSTGVQTSPDLKKCYQTFPLDRKKGNLKSLPAADPFKSQNNGFLTDAKEKNEAGPMEEARPCGAGRVHKTTALVFHSNQHMNTVDQPLGVNCTEPCKSPEPLSYGEAALQNSTRPPSEEPDYQLLGRAKQDRGRPNSEEPAPPALRRVFKTEVATVYAPALSARAPEPGLSDSAAASQWSLCPADDERRRATHLNGLQAPSETALACSPPMQCLSPECSEQPSQTHTPPGLGNQPSPTAVAAGEECQRIVPHTEVVDLKAQLQMMENLISSSQETIKVLLGVIQELEKGEAHREGLSYRTGQDTANCDTCRNSACIIYSVELDFKQQEDKLQPVLRKLHPIEETQVIPSPYSQETYSSTPKQKSKTESKKHGRWKLWFL

SEQ ID NO: 29965 - protein, 455 aa, Homo sapiens; identical to SEQ ID NO: 29963
  Payload ID: 5856
  Gene Symbol: FAM196A
  Gene Name: family with sequence similarity 196, member A
  Uniprot ID: Q6ZSG2
  ENSP ID: ENSP00000479733

SEQ ID NO: 29966 - protein, 535 aa, Homo sapiens
  Payload ID: 5857
  Gene Symbol: FAM196B
  Gene Name: family with sequence similarity 196, member B
  Uniprot ID: A6NMK8
  ENSP ID: ENSP00000366582
MAQQNMKVRPVLLKRNSLESVEFVKQPHHRRSKSQQVRFKEDGTTKNPTGLAEVDVQTPEDPAVMGKTQATRHHLPPTYSLSFPRSQKAGGFRNIAIQTSPSLRKHFPVFKRKRLTASKSLVEMPTASQSAIQVNGNLSEQDIVSSDLAYLRLAQHLEDGPRRVKVSHAFLPRVPKVQSNGPVSICLEAGTWRSLEKATAAIQVPDDIYHSPSWEARESALSPDRSAEVSNSIHPLDDTRPGDGRRVTPLDSEKSTSCLNATSVASHTPGTEELKPELLLPKDNSDDKDLGSLSSQSKETCVPSSPRTHSSPSQGSHSQPAHPGRASDCPSSSNNHQNLVSLKTNSASKSAPGCQEQTANNPTESDTLEFPNCPGSNHLPSSLSRSETKLQSNREISDINQIHLARGELCDLQGRLQSVEESLHSNQEKIKVLLNVIQDLEKARALTEGRNFYRTGQDLNNCSTCQNTACIIYSVEYDFRQQEGRFHEVLQSLEEAEPVEEASPPPKSPAEPPAPEKQDLRRKTKKVKKKCFWWI

SEQ ID NO: 29967 - protein, 575 aa, Homo sapiens
  Payload ID: 5858
  Gene Symbol: FAM198A
  Gene Name: family with sequence similarity 198, member A
  Uniprot ID: Q9UFP1
  ENSP ID: ENSP00000273146
MASWLRRKLRGKRRPVIAFCLLMILSAMAVTRFPPQRPSAGPDPGPMEPQGVTGAPATHIRQALSSSRRQRARNMGFWRSRALPRNSILVCAEEQGHRARVDRSRESPGGDLRHPGRVRRDITLSGHPRLSTQHVVLLREDEVGDPGTKDLGHPQHGSPIQETQSEVVTLVSPLPGSDMAALPAWRATSGLTLWPHTAEGRDLLGAENRALTGGQQAEDPTLASGAHQWPGSVEKLQGSVWCDAETLLSSSRTGGQAPPWLTDHDVQMLRLLAQGEVVDKARVPAHGQVLQVGFSTEAALQDLSSPRLSQLCSQGLCGLIKRPGDLPEVLSFHVDRVLGLRRSLPAVARRFHSPLLPYRYTDGGARPVIWWAPDVQHLSDPDEDQNSLALGWLQYQALLAHSCNWPGQAPCPGIHHTEWARLALFDFLLQVHDRLDRYCCGFEPEPSDPCVEERLREKCQNPAELRLVHILVRSSDPSHLVYIDNAGNLQHPEDKLNFRLLEGIDGFPESAVKVLASGCLQNMLLKSLQMDPVFWESQGGAQGLKQVLQTLEQRGQVLLGHIQKHNLTLFRDEDP

SEQ ID NO: 29968 - protein, 575 aa, Homo sapiens; identical to SEQ ID NO: 29967
  Payload ID: 5858
  Gene Symbol: FAM198A
  Gene Name: family with sequence similarity 198, member A
  Uniprot ID: Q9UFP1
  ENSP ID: ENSP00000407301

SEQ ID NO: 29969 - protein, 140 aa, Homo sapiens
  Payload ID: 5858
  Gene Symbol: FAM198A
  Gene Name: family with sequence similarity 198, member A
  ENSP ID: ENSP00000439905
MVHDRLDRYCCGFEPEPSDPCVEERLREKCQNPAELRLVHILVRSSDPSHLVYIDNAGNLQHPEDKLNFRLLEGIDGFPESAVKVLASGCLQNMLLKSLQMDPVFWESQGGAQGLKQVLQTLEQRGQVLLGHIQKHNLTL

SEQ ID NO: 29970 - protein, 519 aa, Homo sapiens
  Payload ID: 5859
  Gene Symbol: FAM198B
  Gene Name: family with sequence similarity 198, member B
  Uniprot ID: Q6UWH4
  ENSP ID: ENSP00000296530
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRGPGVRAGGPDFLQPSSRESNIRIYSESAPSWLSKDDIRRMRLLADSAVAGLRPVSSRSGARLLVLEGGAPGAVLRCGPSPCGLLKQPLDMSEVFAFHLDRILGLNRTLPSVSRKAEFIQDGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 29971 - protein, 527 aa, Homo sapiens
  Payload ID: 5859
  Gene Symbol: FAM198B
  Gene Name: family with sequence similarity 198, member B
  Uniprot ID: Q6UWH4
  ENSP ID: ENSP00000377396
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRGPGVRAGGPDFLQPSSRESNIRIYSESAPSWLSKDDIRRMRLLADSAVAGLRPVSSRSGARLLVLEGGAPGAVLRCGPSPCGLLKQPLDMSEVFAFHLDRILGLNRTLPSVSRKAEFIQAAAAACLSMRLAFFIFPAWEDMRVPGKCCIGHARLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 29972 - protein, 108 aa, Homo sapiens
  Payload ID: 5859
  Gene Symbol: FAM198B
  Gene Name: family with sequence similarity 198, member B
  ENSP ID: ENSP00000465491
MALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLF

SEQ ID NO: 29973 - protein, 519 aa, Homo sapiens; identical to SEQ ID NO: 29970
  Payload ID: 5859
  Gene Symbol: FAM198B
  Gene Name: family with sequence similarity 198, member B
  Uniprot ID: Q6UWH4
  ENSP ID: ENSP00000465976

SEQ ID NO: 29974 - protein, 9 aa, Homo sapiens
  Payload ID: 5859
  Gene Symbol: FAM198B
  Gene Name: family with sequence similarity 198, member B
  ENSP ID: ENSP00000466595
MTCPDKPGQ

SEQ ID NO: 29975 - protein, 187 aa, Homo sapiens
  Payload ID: 5859
  Gene Symbol: FAM198B
  Gene Name: family with sequence similarity 198, member B
  ENSP ID: ENSP00000466811
MLLISETLQDGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWE

SEQ ID NO: 29976 - protein, 331 aa, Homo sapiens
  Payload ID: 5859
  Gene Symbol: FAM198B
  Gene Name: family with sequence similarity 198, member B
  Uniprot ID: Q6UWH4
  ENSP ID: ENSP00000466873
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRGPGVRAGGPDFLQPSSRESNIRIYSESAPSWLSKDDIRRMRLLADSAVAGLRPVSSRSGARLLVLEGGAPGAVLRCGPSPCGLLKQPLDMSEVFAFHLDRILGLNRTLPSVSRKAEFIQGNRFTCFVICSCWGFWFIFFFPSLSFSK

SEQ ID NO: 29977 - protein, 191 aa, Homo sapiens
  Payload ID: 5859
  Gene Symbol: FAM198B
  Gene Name: family with sequence similarity 198, member B
  ENSP ID: ENSP00000468648
  MOD_RES (1)..(1): Any amino acid
XFSTHGSHLDSSSSSVSFHALGILYFPSLGGYESSREMLYWTCKNGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIK

SEQ ID NO: 29978 - protein, 388 aa, Homo sapiens
  Payload ID: 5860
  Gene Symbol: FAM199X
  Gene Name: family with sequence similarity 199, X-linked
  Uniprot ID: Q6PEV8
  ENSP ID: ENSP00000417581
MSDEASAITSYEKFLTPEEPFPLLGPPRGVGTCPSEEPGCLDISDFGCQLSSCHRTDPLHRFHTNRWNLTSCGTSVASSEGSEELFSSVSVGDQDDCYSLLDDQDFTSFDLFPEGSVCSDVSSSISTYWDWSDSEFEWQLPGSDIASGSDVLSDVIPSIPSSPCLLPKKKNKHRNLDELPWSAMTNDEQVEYIEYLSRKVSTEMGLREQLDIIKIIDPSAQISPTDSEFIIELNCLTDEKLKQVRNYIKEHSPRQRPAREAWKRSNFSCASTSGVSGASASASSSSASMVSSASSSGSSVGNSASNSSANMSRAHSDSNLSASAAERIRDSKKRSKQRKLQQKAFRKRQLKEQRQARKERLSGLFLNEEVLSLKVTEEDHEADVDVLM

SEQ ID NO: 29979 - protein, 127 aa, Homo sapiens
  Payload ID: 5861
  Gene Symbol: FAM20A
  Gene Name: family with sequence similarity 20, member A
  ENSP ID: ENSP00000464910
  MOD_RES (1)..(1): Any amino acid
XFHLWPQVQRQLRPRERPRGCPCTGRASSLARDSAAAASDPGTIVHNFSRTEPRTEPAGGSHSGSSSKLQALFAHPLYNVPEEPPLLGAEDSLLASQEALRYYRRKVARWNRPQFLLLKGRGGVCDP

SEQ ID NO: 29980 - protein, 21 aa, Homo sapiens
  Payload ID: 5861
  Gene Symbol: FAM20A
  Gene Name: family with sequence similarity 20, member A
  ENSP ID: ENSP00000467884
QRHNAEIAAFHLDREYGPAPL

SEQ ID NO: 29981 - protein, 541 aa, Homo sapiens
  Payload ID: 5861
  Gene Symbol: FAM20A
  Gene Name: family with sequence similarity 20, member A
  Uniprot ID: Q96MK3
  ENSP ID: ENSP00000468308
MPGLRRDRLLTLLLLGALLSADLYFHLWPQVQRQLRPRERPRGCPCTGRASSLARDSAAAASDPGTIVHNFSRTEPRTEPAGGSHSGSSSKLQALFAHPLYNVPEEPPLLGAEDSLLASQEALRYYRRKVARWNRRHKMYREQMNLTSLDPPLQLRLEASWVQFHLGINRHGLYSRSSPVVSKLLQDMRHFPTISADYSQDEKALLGACDCTQIVKPSGVHLKLVLRFSDFGKAMFKPMRQQRDEETPVDFFYFIDFQRHNAEIAAFHLDRILDFRRVPPTVGRIVNVTKEILEVTKNEILQSVFFVSPASNVCFFAKCPYMCKTEYAVCGNPHLLEGSLSAFLPSLNLAPRLSVPNPWIRSYTLAGKEEWEVNPLYCDTVKQIYPYNNSQRLLNVIDMAIFDFLIGNMDRHHYEMFTKFGDDGFLIHLDNARGFGRHSHDEISILSPLSQCCMIKKKTLLHLQLLAQADYRLSDVMRESLLEDQLSPVLTEPHLLALDRRLQTILRTVEGCIVAHGQQSVIVDGPVEQLAPDSGQANLTS

SEQ ID NO: 29982 - protein, 145 aa, Homo sapiens
  Payload ID: 5861
  Gene Symbol: FAM20A
  Gene Name: family with sequence similarity 20, member A
  ENSP ID: ENSP00000481085
MFTSPSEGKPGNMDRHHYEMFTKFGDDGFLIHLDNARGFGRHSHDEISILSPLSQCCMIKKKTLLHLQLLAQADYRLSDVMRESLLEDQLSPVLTEPHLLALDRRLQTILRTVEGCIVAHGQQSVIVDGPVEQLAPDSGQANLTS

SEQ ID NO: 29983 - protein, 409 aa, Homo sapiens
  Payload ID: 5862
  Gene Symbol: FAM20B
  Gene Name: family with sequence similarity 20, member B
  Uniprot ID: O75063
  ENSP ID: ENSP00000263733
MKLKQRVVLLAILLVIFIFTKVFLIDNLDTSAANREDQRAFHRMMTGLRVELAPKLDHTLQSPWEIAAQWVVPREVYPEETPELGAVMHAMATKKIIKADVGYKGTQLKALLILEGGQKVVFKPKRYSRDHVVEGEPYAGYDRHNAEVAAFHLDRILGFHRAPLVVGRFVNLRTEIKPVATEQLLSTFLTVGNNTCFYGKCYYCRETEPACADGDIMEGSVTLWLPDVWPLQKHRHPWGRTYREGKLARWEYDESYCDAVKKTSPYDSGPRLLDIIDTAVFDYLIGNADRHHYESFQDDEGASMLILLDNAKSFGNPSLDERSILAPLYQCCIIRVSTWNRLNYLKNGVLKSALKSAMAHDPISPVLSDPHLDAVDQRLLSVLATVKQCTDQFGMDTVLVEDRMPLSHL

SEQ ID NO: 29984 - protein, 138 aa, Homo sapiens
  Payload ID: 5862
  Gene Symbol: FAM20B
  Gene Name: family with sequence similarity 20, member B
  ENSP ID: ENSP00000404005
MKLKQRVVLLAILLVIFIFTKVFLIDNLDTSAANREDQRAFHRMMTGLRVELAPKLDHTLQSPWEIAAQWVVPREVYPEETPELGAVMHAMATKKIIKADVGYKGTQLKALLILEGGQKVVFKPKRYSRDHVVEGEPY

SEQ ID NO: 29985 - protein, 584 aa, Homo sapiens
  Payload ID: 5863
  Gene Symbol: FAM20C
  Gene Name: family with sequence similarity 20, member C
  Uniprot ID: Q8IXL6
  ENSP ID: ENSP00000322323
MKMMLVRRFRVLILMVFLVACALHIALDLLPRLERRGARPSGEPGCSCAQPAAEVAAPGWAQVRGRPGEPPAASSAAGDAGWPNKHTLRILQDFSSDPSSNLSSHSLEKLPPAAEPAERALRGRDPGALRPHDPAHRPLLRDPGPRRSESPPGPGGDASLLARLFEHPLYRVAVPPLTEEDVLFNVNSDTRLSPKAAENPDWPHAGAEGAEFLSPGEAAVDSYPNWLKFHIGINRYELYSRHNPAIEALLHDLSSQRITSVAMKSGGTQLKLIMTFQNYGQALFKPMKQTREQETPPDFFYFSDYERHNAEIAAFHLDRILDFRRVPPVAGRMVNMTKEIRDVTRDKKLWRTFFISPANNICFYGECSYYCSTEHALCGKPDQIEGSLAAFLPDLSLAKRKTWRNPWRRSYHKRKKAEWEVDPDYCEEVKQTPPYDSSHRILDVMDMTIFDFLMGNMDRHHYETFEKFGNETFIIHLDNGRGFGKYSHDELSILVPLQQCCRIRKSTYLRLQLLAKEEYKLSLLMAESLRGDQVAPVLYQPHLEALDRRLRVVLKAVRDCVERNGLHSVVDDDLDTEHRAASAR

SEQ ID NO: 29986 - protein, 261 aa, Homo sapiens
  Payload ID: 5863
  Gene Symbol: FAM20C
  Gene Name: family with sequence similarity 20, member C
  ENSP ID: ENSP00000485770
MKMMLVRRFRVLILMVFLVACALHIALDLLPRLERRGARPSGEPGCSCAQPAAEVAAPGWAQVRGRPGEPPAASSAAGDAGWPNKHTLRILQDFSSDPSSNLSSHSLEKLPPAAEPAERALRGRDPGALRPHDPAHRPLLRDPGPRRSESPPGPGGDASLLARLFEHPLYRVAVPPLTEEDVLFNVNSDTRLSPKAAENPDWPHAGAEGAEFLSPGEAAVDSYPNWLKFHIGINRYELYSRHNPAIEALLHDLSSQRITSV

SEQ ID NO: 29987 - protein, 261 aa, Homo sapiens; identical to SEQ ID NO: 29986
  Payload ID: 5863
  Gene Symbol: FAM20C
  Gene Name: family with sequence similarity 20, member C
  ENSP ID: ENSP00000488297

SEQ ID NO: 29988 - protein, 535 aa, Homo sapiens
  Payload ID: 5864
  Gene Symbol: FAM200A
  Gene Name: family with sequence similarity 200, member A
  ENSP ID: ENSP00000386191
MTPESRDTTDLSPGGTQEMEGIVIVKVEEEDEEDHFQKERNKVESSPQVLSRSTTMNERALLSSYLVAYRVAKEKMAHTAAEKIILPACMDMVRTIFDDKSADKLRTIPLSDNTISRRICTIAKHLEAMLITRLQSGIDFAIQLDESTDIASCPTLLVYVRYVWQDDFVEDLLCCLNLNSHITGLDLFTELENCLLGQYKLNWKHCKGISSDGTANMTGKHSRLTEKLLEATHNNAVWNHCFIHREALVSKEISPSLMDVLKNAVKTVNFIKGSSLNSRLLEIFCSEIGVNHTHLLFHTEVRWLSQGKVLSRVYELRNEIYIFLVEKQSHLANIFEDDIWVTKLAYLSDIFGILNELSLKMQGKNNDIFQYLEHILGFQKTLLLWQARLKSNRPSYYMFPTLLQHIEENIINEDCLKEIKLEILLHLTSLSQTFNYYFPEEKFESLKENIWMKDPFAFQNPESIIELNLEPEEENELLQLSSSFTLKNYYKILSLSAFWIKIKDDFPLLSRKSILLLLPFTTTYLCELGFSILTR

SEQ ID NO: 29989 - protein, 573 aa, Homo sapiens
  Payload ID: 5864
  Gene Symbol: FAM200A
  Gene Name: family with sequence similarity 200, member A
  Uniprot ID: Q8TCP9
  ENSP ID: ENSP00000411372
MTPESRDTTDLSPGGTQEMEGIVIVKVEEEDEEDHFQKERNKVESSPQVLSRSTTMNERALLSSYLVAYRVAKEKMAHTAAEKIILPACMDMVRTIFDDKSADKLRTIPLSDNTISRRICTIAKHLEAMLITRLQSGIDFAIQLDESTDIASCPTLLVYVRYVWQDDFVEDLLCCLNLNSHITGLDLFTELENCLLGQYKLNWKHCKGISSDGTANMTGKHSRLTEKLLEATHNNAVWNHCFIHREALVSKEISPSLMDVLKNAVKTVNFIKGSSLNSRLLEIFCSEIGVNHTHLLFHTEVRWLSQGKVLSRVYELRNEIYIFLVEKQSHLANIFEDDIWVTKLAYLSDIFGILNELSLKMQGKNNDIFQYLEHILGFQKTLLLWQARLKSNRPSYYMFPTLLQHIEENIINEDCLKEIKLEILLHLTSLSQTFNYYFPEEKFESLKENIWMKDPFAFQNPESIIELNLEPEEENELLQLSSSFTLKNYYKILSLSAFWIKIKDDFPLLSRKSILLLLPFTTTYLCELGFSILTRLKTKKRNRLNSAPDMRVALSSCVPDWKELMNRQAHPSH

SEQ ID NO: 29990 - protein, 657 aa, Homo sapiens
  Payload ID: 5865
  Gene Symbol: FAM200B
  Gene Name: family with sequence similarity 200, member B
  Uniprot ID: P0CF97
  ENSP ID: ENSP00000393017
MDHFFIKRKRNSEVKYTEACSSSSVESGIVNSDNIEKNTDSNLQTSTSFEPHFKKKKVSARRYNEDYLKYGFIKCEKPFENDRPQCVICNNILANESLKPSKLKRHLETQHAELIDKPLEYFQRKKKDIKLSTQFLSCSTAVSEKALLSSYLVAYRVAKEKIANTAAEKIILPACLDMVRTIFDDKSADKLKTIPNDNTVSLRICTIAEHLETMLITRLQSGIDFAIQLDESTDIGSCTTLLVYVRYAWQDDFLEDFLCFLNLTSHLSGLDIFTELERRIVGQYKLNWKNCKGITSDGTATMTGKHSRVIKKLLEVTNNGAVWNHCFIHREGLASREIPQNLMEVLKNAVKVVNFIKGSSLNSRLLETFCSEIGTNHTHLLYHTKIRWLSQGKILSRVYELRNEIHFFLIEKKSHLASIFEDDTWVTKLAYLTDIFSILNELSLKLQGKNSDVFQHVERIQGFRKTLLLWQVRLKSNRPSYYMFPRFLQHIEENIINENILKEIKLEILLHLTSLSQTFNHFFPEEKFETLRENSWVKDPFAFRHPESIIELNLVPEEENELLQLSSSYTLKNDYETLSLSAFWMKVKEDFPLLSRKSVLLLLPFTTTSLCELGFSILTQLKTKERNGLNCAAVMRVALSSCVPDWNELMNRQAHPS

SEQ ID NO: 29991 - protein, 24 aa, Homo sapiens
  Payload ID: 5865
  Gene Symbol: FAM200B
  Gene Name: family with sequence similarity 200, member B
  ENSP ID: ENSP00000422751
MDHFFIKRKRNSEVKYTEACSSSS

SEQ ID NO: 29992 - protein, 657 aa, Homo sapiens; identical to SEQ ID NO: 29990
  Payload ID: 5865
  Gene Symbol: FAM200B
  Gene Name: family with sequence similarity 200, member B
  Uniprot ID: P0CF97
  ENSP ID: ENSP00000483930

SEQ ID NO: 29993 - protein, 151 aa, Homo sapiens
  Payload ID: 5866
  Gene Symbol: FAM204A
  Gene Name: family with sequence similarity 204, member A
  ENSP ID: ENSP00000358168
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKDKLKNEKELHSEPSSNETQWKELTQYFGVNDRFDPPVKRKKVEK

SEQ ID NO: 29994 - protein, 233 aa, Homo sapiens
  Payload ID: 5866
  Gene Symbol: FAM204A
  Gene Name: family with sequence similarity 204, member A
  Uniprot ID: Q9H8W3
  ENSP ID: ENSP00000358170
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKDKLKNEKELHSEPSSNETQWKELTQYFGVNDRFDPPVKRKKVEKSGLEKRIDQAVEEWNIEKAEELSNQLATRELGVKIAKAVACHNFVKAKKEVENSQAARKKKKLAWGFEAKKRWETKSNMGYM

SEQ ID NO: 29995 - protein, 233 aa, Homo sapiens; identical to SEQ ID NO: 29994
  Payload ID: 5866
  Gene Symbol: FAM204A
  Gene Name: family with sequence similarity 204, member A
  Uniprot ID: Q9H8W3
  ENSP ID: ENSP00000358183

SEQ ID NO: 29996 - protein, 219 aa, Homo sapiens
  Payload ID: 5866
  Gene Symbol: FAM204A
  Gene Name: family with sequence similarity 204, member A
  ENSP ID: ENSP00000432701
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKDKLKNEKELHSEPSSNETQWKELTQYFGVNDRFDPPVKRKKVEKSGLEKRIDQAVEEWNIEKAEELSNQLATREENHGSNVVCFSVSAIQRLVLSLCPFPDGVTSINYFSLV

SEQ ID NO: 29997 - protein, 1335 aa, Homo sapiens
  Payload ID: 5867
  Gene Symbol: FAM205A
  Gene Name: family with sequence similarity 205, member A
  Uniprot ID: Q6ZU69
  ENSP ID: ENSP00000417711
MLSPTFVLWEVGYPLYIYGSIFIVIVIIWQVKRSHHELSSEPKRSCCRCHQKVRQRARDAASTARRRSREEAEKPQKLLSIIKSQGWLPLERSVRRILCADPCCQICNSVALEIQQLLVGENNQISLTLSGPLQGSSCLEMLSTSSMSLDQSLEFHSWHTRELSLSSVTPTLSQLTDQKSLTQSAAQSTYADGIQDYWADHLQLGQEFQVPDVLRGPNTIASSRIEKPRAPLNQEEMTQSNPSLVQGNQGQHHLNSQVSLLSLNPETLNRMHPMALHMVLPAHLPFLSPEVLRLLEVHVKKWMHFQRWGLPRRVEESLRQLMPNPPLYYQPGNDQPVSFNLKNTPQVSLHRFETISLQTWCSCVAGQPIQTFWVSEWSTMNPEQRHHCQQTPNPMALALPSPALKALSGPHPQSGGQDNDSGSDLQQKYSQLFCGLPSLHSESLVATFMGSQGLPKIENVPKPPLKDPFLFNELSFPQLLPKTSPQSAPPSSPLSPNWMSPSDHQRAQINVPFLTLAEYEALEWHLLQRQLQLQWGWPAALQRSQHTQCLMQHEPCGKAQSPETTTASQTGKSISVLTRELLFFPEHARKLLEFHIQKQLIRHRWGLPQKIQQSIQLLLTSTDQQTVSSSSTALANVSIPQPVALEANGACDVLSPIAAPVSIPRPHLLTQVKAILQSHIDSKCGQIHQGKIPACVHRSWDCRISGVLAVAPFPCIPESQFLELQTASDPDLHHKVMPWMPTALDQQQQALPGTVTEHPKLLRVLSVEAIEKLETTLRHKHLAFLSGLPALYYVALPRALAPAVTSQSVITEMEPSPVEIPAEPLIQMVSFEEQCISLGPCPQGNNESCTDVAKEFQPAVPVKGTMETLPLESQTHPTSPHSLQTHILTKLNFHLRKKVLEIQWGIPIRARKSREQTVAAPENISTQKSLESLNHQGETLLQELPIPPDTLPAPNPEGVHLKEQLANDLKAVQQNQKQSNSKAVPQGSAHSVSKISQPSGDMTEAHMPCVQVEANVNKPSLEEPCGPEPQSPSKSKDPAHVPMLAGNREDPEETKAARDHREGDAGFGRSSTREERRPAEDQRPAGMLPNKTPRGSWRWSRSFHLADPCQHSPQHHPQLKLPQLPPRVPGEKESEKDLQDSQTKLTVILEPATIPENAQTVLPQASQGQPFLSQPTQAKPLQGQTLQGQVLHGLVMPVHAQKKPSLTESSFRNKIKCFLQHINPKTKGKGHEDSMFSAAAKVAKTRKENVAKSLAPAKSPVGRSKTEKPTGCSKAQSRPAQKLVGPAFLDGPQSLDDKLRLHSRQPGSASALGYPRHCPRHCPREACANKPGHPT

SEQ ID NO: 29998 - protein, 128 aa, Homo sapiens
  Payload ID: 5868
  Gene Symbol: FAM205C
  Gene Name: family with sequence similarity 205, member C
  ENSP ID: ENSP00000489523
MLSPTFVLWDVGYPLYTYGSICIIALIIWQVKKSCQKLSLVPNRSCCRCHRRVQQKSGDRTSRARRTSQEEAEKLWKLLFLMKSQGWLPQEGSVRRILCADPCCQICNVMALEIKQLLKLQKLAWITR

SEQ ID NO: 29999 - protein, 208 aa, Homo sapiens
  Payload ID: 5868
  Gene Symbol: FAM205C
  Gene Name: family with sequence similarity 205, member C
  ENSP ID: ENSP00000489571
MLSPTFVLWDVGYPLYTYGSICIIALIIWQVKKSCQKLSLVPNRSCCRCHRRVQQKSGDRTSRARRTSQEEAEKLWKLLFLMKSQGWLPQEGSVRRILCADPCCQICNVMALEIKQLLAAPEVGLDNKMKLFLHWINPEMKDRRHEESILLSKAETVTQDRTKNIEKSPTVTKDHVWGATTQKTTEDPEAQPPSTEEEGLIFCDAPSA

SEQ ID NO: 30000 - protein, 338 aa, Homo sapiens
  Payload ID: 5868
  Gene Symbol: FAM205C
  Gene Name: family with sequence similarity 205, member C
  Uniprot ID: A6NFA0
  ENSP ID: ENSP00000489585
MLSPTFVLWDVGYPLYTYGSICIIALIIWQVKKSCQKLSLVPNRSCCRCHRRVQQKSGDRTSRARRTSQEEAEKLWKLLFLMKSQGWLPQEGSVRRILCADPCCQICNVMALEIKQLLAGENNQISLTSLGPSQGSSCLEALSTSSVSFKHSQDLGSPKSKELSLASVTPTLSQLMDQKSLTQSAARSAGADSVQDSWADHFQRGQRSQVPAVSQVMGSLSSNFEKPGIPLSQQERTKNNSKFVLENQEAPEVGLDNKMKLFLHWINPEMKDRRHEESILLSKAETVTQDRTKNIEKSPTVTKDHVWGATTQKTTEDPEAQPPSTEEEGLIFCDAPSA

SEQ ID NO: 30001 - protein, 181 aa, Homo sapiens
  Payload ID: 5869
  Gene Symbol: FAM206A
  Gene Name: family with sequence similarity 206, member A
  Uniprot ID: Q9NX38
  ENSP ID: ENSP00000363753
MATEPEAAEPVVPSLVDRYFTRWYKPDVKGKFCEDHCILQHSNRICVITLAESHPVLQSGKTIKSISYQISTNCSRLQNKVSGKFKRGAQFLTELAPLCKIYCSDGEEYTVSSCVRGRLMEVNENILHKPSILQEKPSTEGYIAVVLPKFEESKSITEGLLTQKQYEEVMVKRINATTATS

SEQ ID NO: 30002 - protein, 115 aa, Homo sapiens
  Payload ID: 5869
  Gene Symbol: FAM206A
  Gene Name: family with sequence similarity 206, member A
  ENSP ID: ENSP00000363754
MATEPEAAEPVVPSLVDRYFTRWYKPDVKGKFCEDHCILQHSNRICVITLAESHPVLQSGKTIKSISYQISTNCSRLQNKVSGKFKRRIIYLEKVEDVIKRKMMPLSLGLHLPHS

SEQ ID NO: 30003 - protein, 129 aa, Homo sapiens
  Payload ID: 5869
  Gene Symbol: FAM206A
  Gene Name: family with sequence similarity 206, member A
  ENSP ID: ENSP00000398018
ILHSLVQTGICVITLAESHPVLQSGKTIKSISYQISTNCSRLQNKVSGKFKRGAQFLTELAPLCKIYCSDGEEYTVSSCVRGRLMEVNENILHKPSILQEKPSTEGYIAVVLPKFEESKSITEGLLTQK

SEQ ID NO: 30004 - protein, 230 aa, Homo sapiens
  Payload ID: 5870
  Gene Symbol: FAM207A
  Gene Name: family with sequence similarity 207, member A
  Uniprot ID: Q9NSI2
  ENSP ID: ENSP00000291634
MGKVRGLRARVHQAAVRPKGEAAPGPAPPAPEATPPPASAAGKDWAFINTNIFARTKIDPSALVQKLELDVRSVTSVRRGEAGSSARSVPSIRRGAEAKTVLPKKEKMKLRREQWLQKIEAIKLAEQKHREERRRRATVVVGDLHPLRDALPELLGLEAGSRRQARSRESNKPRPSELSRMSAAQRQQLLEEERTRFQELLASPAYRASPLVAIGQTLARQMQLEDGGQL

SEQ ID NO: 30005 - protein, 215 aa, Homo sapiens
  Payload ID: 5870
  Gene Symbol: FAM207A
  Gene Name: family with sequence similarity 207, member A
  Uniprot ID: Q9NSI2
  ENSP ID: ENSP00000380926
MGKVRGLRARVHQAAVRPKGEAAPGPAPPAPEATPPPASAAGKDWAFINTNIFARTKIDPSALVQKLELDVRSVTSVRRGAEAKTVLPKKEKMKLRREQWLQKIEAIKLAEQKHREERRRRATVVVGDLHPLRDALPELLGLEAGSRRQARSRESNKPRPSELSRMSAAQRQQLLEEERTRFQELLASPAYRASPLVAIGQTLARQMQLEDGGQL

SEQ ID NO: 30006 - protein, 203 aa, Homo sapiens
  Payload ID: 5870
  Gene Symbol: FAM207A
  Gene Name: family with sequence similarity 207, member A
  ENSP ID: ENSP00000404964
MGKVRGLRARVHQAAVRPKGEAAPGPAPPAPEATPPPASAAGKDWAFINTNIFARTKIDPSALVQKLELDVRSVTSVRRGAEAKTVLPKKEKMKLRREQWLQKIEAIKLAEQKHREERRRRATVVVGDLHPLRDALPELLGLEAGSRRQARRKQGLCAVSNLGSILSWPSCPGSRVAGHALQAQAAPGWHPAAEAPEHWVQNR

SEQ ID NO: 30007 - protein, 1609 aa, Homo sapiens
  Payload ID: 5871
  Gene Symbol: FAM208A
  Gene Name: family with sequence similarity 208, member A
  Uniprot ID: Q9UK61
  ENSP ID: ENSP00000347845
MATAVETEACQPTDASWESGGGGDDEMKQALPELESSQQNGGGGGLNIAEPSGGAGREENAGAEAAQSLSHEQPQDSSEAGAAALPRGPEEPERPVRRSFQIPRKSREKKALFQPLTPGSREFEDVVNILHSSYLEPTSVTNFNYRRACLVHNELLEKEFTEKRRELKFDGRLDKELSESYAFLMVDRYQVQTICEKGLHVGQSKITILGSPSMGVYLSRYADLLQANPLDTGAMGDVVIFKIMKGKIKSIYDPMGVKSLESMLNKSALDPTPKHECHVSKNANRITSLLAYRAYELTQYYFYEYGFDELRRRPRHVCPYAVVSFTYKDDIQTPKFVPSSRSNSFNTDRNIDKYNYTLWKGQLLNKGKLLCYISLRSATRAFLPIKLPEKLDVETVMSIDHLKQKIPPALFYKETYLGPNEVLKNGMYCSLYEVVEKTRIGSNMESLLQKLDREKLVLVKPLGDRGYLFLLSPYQMVPPYEYQTAKSRVLHALFLFQEPRSIVTSQKGSTNAAPQERHESMPDVLKIAQFLQFSLIQCRKEFKNISAINFHSVVEKYVSEFFKRGFGSGKREFIMFPYDSRLDDKKFLYSAPRNKSHIDTCLHAYIFRPEVYQLPICKLKELFEENRKLQQFSPLSDYEGQEEEMNGTKMKFGKRNNSRGEAIISGKQRSSHSLDYDKDRVKELINLIQCRKKSVGGDSDTEDMRSKTVLKRKLEDLPENMRKLAKTSNLSENCHLYEESPQPIGSLGHDADLRRQQQDTCNSGIADIHRLFNWLSETLANARHSDASLTDTVNKALGLSTDDAYEELRQKHEYELNSTPDKKDYEQPTCAKVENAQFKGTQSLLLEVDATSKYSVAISTSEVGTDHKLHLKEDPNLISVNNFEDCSLCPSVPIEHGFRRQQSKSNNVEETEIHWKLIPITDTLKGTTEDDVLTGQVEEQCVPAAEAEPPAVSETTERTVLGEYNLFSRKIEEILKQKNVSYVSTVSTPIFSTQEKMKRLSEFIYSKTSKAGVQEFVDGLHEKLNTIIIKASAKGGNLPPVSPNDSGAKIASNPLERHVIPVSSSDFNNKHLLEPLCSDPLKDTNSDEQHSTSALTEVEMNQPQHATELMVTSDHIVPGDMAREPVEETTKSPSDVNISAQPALSNFISQLEPEVFNSLVKIMKDVQKNTVKFYIHEEEESVLCKEIKEYLIKLGNTECHPEQFLERRSKLDKLLIIIQNEDIAGFIHKIPGLVTLKKLPCVSFAGVDSLDDVKNHTYNELFVSGGFIVSDESILNPEVVTVENLKNFLTFLEELSTPEGKWQWKVHCKFQKKLKELGRLNAKALSLLTLLNVYQKKHLVEILSYHNCDSQTRNAPELDCLIRLQAQNIQQRHIVFLTEKNIKMLSSYTDNGIVVATAEDFMQNFKNLVGYHNSITEENLPQLGANENLESQSALLENDEKDEEDMSLDSGDEISHIEVCSNFHSEIWEKETKGSRGTDQKKNTQIELQSSPDVQNSLLEDKTYLDSEERTSIDIVCSEGENSNSTEQDSYSNFQVYHSQLNMSHQFSHFNVLTHQTFLGTPYALSSSQSQENENYFLSAYTESLDRDKSPPPLSWGKSDSSRPYSQEK

SEQ ID NO: 30008 - protein, 1233 aa, Homo sapiens
  Payload ID: 5871
  Gene Symbol: FAM208A
  Gene Name: family with sequence similarity 208, member A
  Uniprot ID: Q9UK61
  ENSP ID: ENSP00000399410
MSIDHLKQKIPPALFYKETYLGPNEVLKNGMYCSLYEVVEKTRIGSNMESLLQKLDREKLVLVKPLGDRGYLFLLSPYQMVPPYEYQTAKSRVLHALFLFQEPRSIVTSQKGSTNAAPQERHESMPDVLKIAQFLQFSLIQCRKEFKNISAINFHSVVEKYVSEFFKRGFGSGKREFIMFPYDSRLDDKKFLYSAPRNKSHIDTCLHAYIFRPEVYQLPICKLKELFEENRKLQQFSPLSDYEGQEEEMNGTKMKFGKRNNSRGEAIISGKQRSSHSLDYDKDRVKELINLIQCRKKSVGGDSDTEDMRSKTVLKRKLEDLPENMRKLAKTSNLSENCHLYEESPQPIGSLGHDADLRRQQQDTCNSGIADIHRLFNWLSETLANARHSDASLTDTVNKALGLSTDDAYEELRQKHEYELNSTPDKKDYEQPTCAKVENAQFKGTQSLLLEVDATSKYSVAISTSEVGTDHKLHLKEDPNLISVNNFEDCSLCPSVPIEHGFRRQQSKSNNVEETEIHWKLIPITGGNARSPEDQLGKHGEKQTPDTLKGTTEDDVLTGQVEEQCVPAAEAEPPAVSETTERTVLGEYNLFSRKIEEILKQKNVSYVSTVSTPIFSTQEKMKRLSEFIYSKTSKAGVQEFVDGLHEKLNTIIIKASAKGGNLPPVSPNDSGAKIASNPLERHVIPVSSSDFNNKHLLEPLCSDPLKDTNSDEQHSTSALTEVEMNQPQHATELMVTSDHIVPGDMAREPVEETTKSPSDVNISAQPALSNFISQLEPEVFNSLVKIMKDVQKNTVKFYIHEEEESVLCKEIKEYLIKLGNTECHPEQFLERRSKLDKLLIIIQNEDIAGFIHKIPGLVTLKKLPCVSFAGVDSLDDVKNHTYNELFVSGGFIVSDESILNPEVVTVENLKNFLTFLEELSTPEGKWQWKVHCKFQKKLKELGRLNAKALSLLTLLNVYQKKHLVEILSYHNCDSQTRNAPELDCLIRLQAQNIQQRHIVFLTEKNIKMLSSYTDNGIVVATAEDFMQNFKNLVGYHNSITEENLPQLGANENLESQSALLENDEKDEEDMSLDSGDEISHIEVCSNFHSEIWEKETKGSRGTDQKKNTQIELQSSPDVQNSLLEDKTYLDSEERTSIDIVCSEGENSNSTEQDSYSNFQVYHSQLNMSHQFSHFNVLTHQTFLGTPYALSSSQSQENENYFLSAYTESLDRDKSPPPLSWGKSDSSRPYSQEK

SEQ ID NO: 30009 - protein, 1512 aa, Homo sapiens
  Payload ID: 5871
  Gene Symbol: FAM208A
  Gene Name: family with sequence similarity 208, member A
  Uniprot ID: Q9UK61
  ENSP ID: ENSP00000417509
MATAVETEACQPTDASWESGGGGDDEMKQALPELESSQQNGGGGGLNIAEPSGGAGREENAGAEAAQSLSHEQPQDSSEAGAAALPRGPEEPERPVRRSFQIPRKSREKKALFQPLTPGSREFEDVVNILHSSYLEPTSVTNFNYRRACLVHNELLEKEFTEKRRELKFDGRLDKELSESYAFLMVDRYQVQTICEKGLHVGQSKITILGSPSMGVYLSRYADLLQANPLDTGAMGDVVIFKIMKGKIKSIYDPMGVKSLESMLNKSALDPTPKHECHVSKNANRITSLLAYRAYELTQYYFYEYGFDELRRRPRHVCPYAVVSFTYKDDIQTPKFVPSSRSNSFNTDRNIDKYNYTLWKGQLLNKGKLLCYISLRSATRAFLPIKLPEKLDVETVMSIDHLKQKIPPALFYKETYLGPNEVLKNGMYCSLYEVVEKTRIGSNMESLLQKLDREKLVLVKPLGDRGYLFLLSPYQMVPPYEYQTAKSRVLHALFLFQEPRSIVTSQKGSTNAAPQERHESMPDVLKIAQFLQFSLIQCRKEFKNISAINFHSVVEKYVSEFFKRGFGSGKREFIMFPYDSRLDDKKFLYSAPRNKSHIDTCLHAYIFRPEVYQLPICKLKELFEENRKLQQFSPLSDYEGQEEEMNGTKMKFGKRNNSRGEAIISGKQRSSHSLDYDKDRVKELINLIQCRKKSVGGDSDTEDMRSKTVLKRKLEDLPENMRKLAKTSNLSENCHLYEESPQPIGSLGHDADLRRQQQDTCNSGIADIHRLFNWLSETLANARHSDASLTDTVNKALGLSTDDAYEELRQKHEYELNSTPDKKDYEQPTCAKVENAQFKGTQSLLLEVDATSKYSVAISTSEVGTDHKLHLKEDPNLISVNNFEDCSLCPSVPIEHGFRRQQSKSNNVEETEIHWKLIPITGGNARSPEDQLGKHGEKQTPGMKSPEEQLVCVPPQEAFPNDPRVINRQRSSDYQFPSSPFTDTLKGTTEDDVLTGQVEEQCVPAAEAEPPAVSETTERTVLGEYNLFSRKIEEILKQKNVSYVSTVSTPIFSTQEKMKRLSEFIYSKTSKAGVQEFVDGLHEKLNTIIIKASAKGGNLPPVSPNDSGAKIASNPLERHVIPVSSSDFNNKHLLEPLCSDPLKDTNSDEQHSTSALTEVEMNQPQHATELMVTSDHIVPGDMAREPVEETTKSPSDVNISAQPALSNFISQLEPEVFNSLVKIMKDVQKNTVKFYIHEEEESVLCKEIKEYLIKLGNTECHPEQFLERRSKLDKLLIIIQNEDIAGFIHKIPGLVTLKKLPCVSFAGVDSLDDVKNHTYNELFVSGGFIVSDESILNPEVVTVENLKNFLTFLEELSTPEGKWQWKVHCKFQKKLKELGRLNAKALSLLTLLNVYQKKHLVEILSYHNCDSQTRNAPELDCLIRLQAQNIQQRHIVFLTEKNIKMLSSYTDNGIVVATAEDFMQNFKNLVGYHNSITEENLPQLGANENLESQSDAVLTLTPLELGVGISQH

SEQ ID NO: 30010 - protein, 1035 aa, Homo sapiens
  Payload ID: 5871
  Gene Symbol: FAM208A
  Gene Name: family with sequence similarity 208, member A
  ENSP ID: ENSP00000483340
MFPYDSRLDDKKFLYSAPRNKSHIDTCLHAYIFRPEVYQLPICKLKELFEENRKLQQFSPLSDYEGQEEEMNGTKMKFGKRNNSRGEAIISGKQRSSHSLDYDKDRVKELINLIQCRKKSVGGDSDTEDMRSKTVLKRKLEDLPENMRKLAKTSNLSENCHLYEESPQPIGSLGHDADLRRQQQDTCNSGIADIHRLFNWLSETLANARHSDASLTDTVNKALGLSTDDAYEELRQKHEYELNSTPDKKDYEQPTCAKVENAQFKGTQSLLLEVDATSKYSVAISTSEVGTDHKLHLKEDPNLISVNNFEDCSLCPSVPIEHGFRRQQSKSNNVEETEIHWKLIPITDTLKGTTEDDVLTGQVEEQCVPAAEAEPPAVSETTERTVLGEYNLFSRKIEEILKQKNVSYVSTVSTPIFSTQEKMKRLSEFIYSKTSKAGVQEFVDGLHEKLNTIIIKASAKGGNLPPVSPNDSGAKIASNPLERHVIPVSSSDFNNKHLLEPLCSDPLKDTNSDEQHSTSALTEVEMNQPQHATELMVTSDHIVPGDMAREPVEETTKSPSDVNISAQPALSNFISQLEPEVFNSLVKIMKDVQKNTVKFYIHEEEESVLCKEIKEYLIKLGNTECHPEQFLERRSKLDKLLIIIQNEDIAGFIHKIPGLVTLKKLPCVSFAGVDSLDDVKNHTYNELFVSGGFIVSDESILNPEVVTVENLKNFLTFLEELSTPEGKWQWKVHCKFQKKLKELGRLNAKALSLLTLLNVYQKKHLVEILSYHNCDSQTRNAPELDCLIRLQAQNIQQRHIVFLTEKNIKMLSSYTDNGIVVATAEDFMQNFKNLVGYHNSITEENLPQLGANENLESQSALLENDEKDEEDMSLDSGDEISHIEVCSNFHSEIWEKETKGSRGTDQKKNTQIELQSSPDVQNSLLEDKTYLDSEERTSIDIVCSEGENSNSTEQDSYSNFQVYHSQLNMSHQFSHFNVLTHQTFLGTPYALSSSQSQENENYFLSAYTESLDRDKSPPPLSWGKSDSSRPYSQEK

SEQ ID NO: 30011 - protein, 2430 aa, Homo sapiens
  Payload ID: 5872
  Gene Symbol: FAM208B
  Gene Name: family with sequence similarity 208, member B
  Uniprot ID: Q5VWN6
  ENSP ID: ENSP00000328426
MAPPAHKSILERSENVLMSPWKGKLIVQDRMLCDIALWSTYGAMIPTQLPQELDFKYVMKVSSLKKRLPEAAFRKQNYLEEKVCFQDLCFNLYEVELSNRQGENIDKLTECIKNKQLAIIKCLEDRGFFILLTSSALLSEPDFGGKQMGLHGLHLFRSPLSTGVKDLKVEDDISMKVIPILSTLNCALLETKKSLPEERIHPNTLVKRHFQELYKADRSPSLSVAPQDRMKDPTFLGKLPSGFDLIPPAEKCPSESLTQLNSYFSDPSAYILEVSTALDLLAEHPQSPCVSDGICDAGFSLVMTPDPEFLVSEAEVRKETETKKDSEEMLKAKKRVFPLSPASNLRVQPKRKASMPHMVQSKKVNLCRPFPKRTASRADNSSDSPTTLKLVKGQFPQKRKRGAEVLTAQFVQKTKLDRKNQEAPISKDVPVPTNAKRARKQEKSPVKTVPRAKPPVKKSPQKQRVNIVKGNENPRNRKQLQPVKGETASKLQSEISRGCQEDGISINSVQPENTTAAHNDLPENSIVNYDSQALNMLADLALSSATSSTPVSEARNLHCSSELPQNDVLLSKENSLRGTSDHEYHRGVKTQKGELLPNPSSDRKSNSGSDLTVSQDEESLVPCSQAPAKAQSALTEEMLESSDASQSSSVSVEHSYALLLTEHSKKHLQEREILSPLFPRNGTKSPEAATPVGKVMPFRHQPGLLLQQKPPDDPVVKPKDRPPSARVKKSSCSRIVLSCDDSVKITFKCETEYAFSLDSKYTNNPLEKTVVRALHGPWNTDLPDNVEEVKLLLHMWVALFYSNQNKIIRSSRKVVEHSNPAKYVSINSTLESCELREIEESLGLEKCSADSLLETNEISRAHAAEVSFRDPNCLLPFIKTPLTQGLELCVQNEQKKTFARECDPDTQEDQNFICSYNNEVTGEEAKQESLETSNLVLSGIGSTQTNGPSVPSEEEIVQPLDSTRVASYSGTVTQATFTRTYDGPGSQPVICQSSVYGTLENKVDILDAAVQTKTGTLQDLIQHGSPINNECHPSLERKDDNMGCAVINPEPITLTFEKNAHVPIQTEGVNTADERTTFKKELIKQVSPAASLRHPVSTSENARTQGLRDIPSLVVAGQKGTKYLCASSVGGETLDKAVCSLQKETPLPVSLPSDKTMVMEALSLAKSSSHLSPSEEVRCTQDFLSQTQSLLGLSSEGLLELTQVEVDSSSASTTLGRQCSLNCISSGCHTSGDSLELRKNHKNGPNTENMNLEAFDSVFIKQTSLSVSREVSLELSEEDSDIDLALTISPPTSPREEMPAGEIEQFEEAPFSNLELQDVAEEIGEPEEVALTESREVSSADNVSVYPSVSEEPVENKERKGDNLQPVTLILSKENCTLEIAEEINVTSDFPFDSVIEEVSPASSPEPPVPVKETRPYQAVTPCILKLHGTQCEKSNQISQCESEDLGITEKENVFVGPTHPVGQDNFTQVQQMQVSAEMPLILTDHPGRTGRPTLPGKVTEEIVSSEHDEGLSFSGKVQCYGRELNQPASAAKCTGDFSPSPEKLVKSGNPLQPVSIENRNLDLKHLVLESSEPPFGPRNVIENKSLSDTLVSTTAPSGIVNVSVKQQTSPKSSQNHLFPGDLKTDEGIYLQVKSLTAASVDGAYSTQGCMCSVVPTLCSSSDNATLTHYVRPINAEPVFQAQEIPAGRMASLLKNGEPEAELHKETTGPGTAGPQSNTTSSLKGERKAIHTLQDVSTCETKELLNVGVSSLCAGPYQNTADTKENLSKEPLASFVSESFDTSVCGIATEHVEIENSGEGLRAEAGSETLGRDGEVGVNSDMHYELSGDSDLDLLGDCRNPRLDLEDSYTLRGSYTRKKDVPTDGYESSLNFHNNNQEDWGCSSWVPGMETSLPPGHWTAAVKKEEKCVPPYVQIRDLHGILRTYANFSITKELKDTMRTSHGLRRHPSFSANCGLPSSWTSTWQVADDLTQNTLDLEYLRFAHKLKQTIKNGDSQHSASSANVFPKESPTQISIGAFPSTKISEAPFLHPAPRSRSPLLVTVVESDPRPQGQPRRGYTASSLDSSSSWRERCSHNRDLRNSQRNHTVSFHLNKLKYNSTVKESRNDISLILNEYAEFNKVMKNSNQFIFQDKELNDVSGEATAQEMYLPFPGRSASYEDIIIDVCTNLHVKLRSVVKEACKSTFLFYLVETEDKSFFVRTKNLLRKGGHTEIEPQHFCQAFHRENDTLIIIIRNEDISSHLHQIPSLLKLKHFPSVIFAGVDSPGDVLDHTYQELFRAGGFVISDDKILEAVTLVQLKEIIKILEKLNGNGRWKWLLHYRENKKLKEDERVDSTAHKKNIMLKSFQSANIIELLHYHQCDSRSSTKAEILKCLLNLQIQHIDARFAVLLTDKPTIPREVFENSGILVTDVNNFIENIEKIAAPFRSSYW

SEQ ID NO: 30012 - protein, 246 aa, Homo sapiens
  Payload ID: 5872
  Gene Symbol: FAM208B
  Gene Name: family with sequence similarity 208, member B
  ENSP ID: ENSP00000369623
  MOD_RES (1)..(1): Any amino acid
XLSVAPQDRMKDPTFLGKLPSGFDLIPPAEKCPSESLTQLNSYFSDPSAYILEVSTALDLLAEHPQSPCVSDGICDAGFSLVMTPDPEFLVSEAEVRKETETKKDSEEMLKAKKRVFPLSPASNLRVQPKRKASMPHMVQSKKVNLCRPFPKRTASRADNSSDSPTTLKLVKGQFPQKRKRVKGETASKLQSEISRGCQEDGISINSVQPENTTAAHNDLPENSIVNYDSQALNMLADLALSSATS

SEQ ID NO: 30013 - protein, 8 aa, Homo sapiens
  Payload ID: 5872
  Gene Symbol: FAM208B
  Gene Name: family with sequence similarity 208, member B
  ENSP ID: ENSP00000434941
MAPPAHKS

SEQ ID NO: 30014 - protein, 171 aa, Homo sapiens
  Payload ID: 5873
  Gene Symbol: FAM209A
  Gene Name: family with sequence similarity 209, member A
  Uniprot ID: Q5JX71
  ENSP ID: ENSP00000360379
MWTLKSSLVLLLCLTCSYAFMFSSLRQKTSEPQGKVQYGEHFRIRQNLPEHTQGWLGSKWLWLLFVVVPFVILQCQRDSEKNKEQSPPGLRGGQLHSPLKKKRNASPNKDCAFNTLMELEVELMKFVSKVRNLKRAMATGSGSNLRLRKSEMPADPYHVTICEIWGEESSS

SEQ ID NO: 30015 - protein, 171 aa, Homo sapiens
  Payload ID: 5874
  Gene Symbol: FAM209B
  Gene Name: family with sequence similarity 209, member B
  Uniprot ID: Q5JX69
  ENSP ID: ENSP00000360376
MWTLKSSLVLLLCLTCSYAFMFSSLRQKTSEPQGKVPCGEHFRIRQNLPEHTQGWLGSKWLWLLFAVVPFVILQCQRDSEKNKEQSPPGLRGFPFRTPLKKNQNASLYKDCVFNTLNELEVELLKFVSEVQNLKGAMATGSGSNLKLRRSEMPADPYHVTICKIWGEESSS

SEQ ID NO: 30016 - protein, 1341 aa, Homo sapiens
  Payload ID: 5875
  Gene Symbol: FAM21A
  Gene Name: family with sequence similarity 21, member A
  Uniprot ID: Q641Q2
  ENSP ID: ENSP00000282633
MMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 30017 - protein, 1279 aa, Homo sapiens
  Payload ID: 5875
  Gene Symbol: FAM21A
  Gene Name: family with sequence similarity 21, member A
  ENSP ID: ENSP00000314417
MMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 30018 - protein, 1320 aa, Homo sapiens
  Payload ID: 5875
  Gene Symbol: FAM21A
  Gene Name: family with sequence similarity 21, member A
  Uniprot ID: Q641Q2
  ENSP ID: ENSP00000344037
MMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 30019 - protein, 1253 aa, Homo sapiens
  Payload ID: 5875
  Gene Symbol: FAM21A
  Gene Name: family with sequence similarity 21, member A
  ENSP ID: ENSP00000382277
MPRLSGKSVRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 30020 - protein, 156 aa, Homo sapiens
  Payload ID: 5875
  Gene Symbol: FAM21A
  Gene Name: family with sequence similarity 21, member A
  ENSP ID: ENSP00000398095
SPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQVRNPL

SEQ ID NO: 30021 - protein, 106 aa, Homo sapiens
  Payload ID: 5875
  Gene Symbol: FAM21A
  Gene Name: family with sequence similarity 21, member A
  ENSP ID: ENSP00000403781
MMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEKAL

SEQ ID NO: 30022 - protein, 1245 aa, Homo sapiens
  Payload ID: 5875
  Gene Symbol: FAM21A
  Gene Name: family with sequence similarity 21, member A
  ENSP ID: ENSP00000481763
MMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTNEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 30023 - protein, 1341 aa, Homo sapiens [sequence omitted]
